(12) United States Patent
Amaral et al.

(10) Patent No.: US 11,965,030 B2
(45) Date of Patent: Apr. 23, 2024

(54) MULTISPECIFIC BINDING PROTEINS WITH MUTANT FAB DOMAINS

(71) Applicant: SANOFI, Paris (FR)

(72) Inventors: Marta Amaral, Frankfurt am Main (DE); Christian Beil, Frankfurt am Main (DE); Ingo Focken, Frankfurt am Main (DE); Gerhard Hessler, Frankfurt am Main (DE); Soraya Hoelper, Frankfurt am Main (DE); Jennifer Jung, Frankfurt am Main (DE); Christian Lange, Frankfurt am Main (DE); Wulf-Dirk Leuschner, Frankfurt am Main (DE); Ercole Rao, Frankfurt am Main (DE); Garima Tiwari, Frankfurt am Main (DE); Sandra Weil, Frankfurt am Main (DE)

(73) Assignee: SANOFI, Paris (FR)

( * ) Notice: Subject to any disclaimer, the term of this patent is extended or adjusted under 35 U.S.C. 154(b) by 189 days.

(21) Appl. No.: 16/725,228

(22) Filed: Dec. 23, 2019

(65) Prior Publication Data

US 2020/0262926 A1   Aug. 20, 2020

(30) Foreign Application Priority Data

Dec. 24, 2018 (EP) .................................... 18306843
Jun. 21, 2019 (EP) .................................... 19305812

(51) Int. Cl.
*C07K 16/28* (2006.01)

(52) U.S. Cl.
CPC ...... *C07K 16/2878* (2013.01); *C07K 16/2827* (2013.01); *C07K 2317/31* (2013.01); *C07K 2317/522* (2013.01); *C07K 2317/524* (2013.01); *C07K 2317/526* (2013.01); *C07K 2317/53* (2013.01); *C07K 2317/55* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 5,732,168 | A | 3/1998 | Donald |
| 5,959,083 | A | 9/1999 | Bosslet et al. |
| 5,989,830 | A | 11/1999 | Davis et al. |
| 6,066,719 | A | 5/2000 | Rinderknecht et al. |
| 6,833,441 | B2 | 12/2004 | Wang et al. |
| 7,612,181 | B2 | 11/2009 | Wu et al. |
| 8,216,805 | B2 | 7/2012 | Carter et al. |
| 8,420,783 | B2 | 4/2013 | Goldenberg et al. |
| 8,703,132 | B2 | 4/2014 | Imhof-Jung et al. |
| 8,722,859 | B2 | 5/2014 | Miller et al. |
| 8,796,424 | B2 | 8/2014 | Croasdale et al. |
| 8,871,912 | B2 | 10/2014 | Davis et al. |
| 9,181,349 | B2 | 11/2015 | Baurin et al. |
| 9,382,323 | B2 | 7/2016 | Brinkmann et al. |
| 9,458,244 | B2 | 10/2016 | Benatuil et al. |
| 9,580,509 | B2 | 2/2017 | Dimasi et al. |
| 9,676,845 | B2 | 6/2017 | Imhof-Jung et al. |
| 9,758,594 | B2 | 9/2017 | Takahashi |
| 9,834,615 | B2 | 12/2017 | Fischer et al. |
| 9,879,081 | B2 | 1/2018 | Suh et al. |
| 9,890,204 | B2 | 2/2018 | Brinkmann et al. |
| 9,963,510 | B2 | 5/2018 | Johnson et al. |
| 2004/0110226 | A1 | 6/2004 | Lazar et al. |
| 2011/0293613 | A1 | 12/2011 | Brinkmann et al. |
| 2012/0195900 | A1 | 8/2012 | Ghayur et al. |
| 2012/0283415 | A1 | 11/2012 | Humphreys et al. |
| 2013/0053549 | A1 | 2/2013 | Adams et al. |
| 2013/0058937 | A1 | 3/2013 | Auer et al. |
| 2013/0060011 | A1 | 3/2013 | Bruenker et al. |
| 2014/0243228 | A1 | 8/2014 | Benatuil et al. |
| 2014/0302037 | A1 | 10/2014 | Borges et al. |
| 2015/0203591 | A1 | 7/2015 | Yancopoulos et al. |
| 2015/0315296 | A1* | 11/2015 | Schaefer ................ A61P 19/00 435/254.2 |
| 2016/0017057 | A1 | 1/2016 | Dave et al. |
| 2016/0115241 | A1* | 4/2016 | Yan ........................ A61P 35/00 424/136.1 |
| 2016/0251438 | A1 | 9/2016 | Lucas et al. |
| 2016/0289341 | A1 | 10/2016 | Wu |
| 2016/0319036 | A1 | 11/2016 | Bruenker et al. |
| 2016/0333105 | A1 | 11/2016 | Adams et al. |
| 2016/0368985 | A1* | 12/2016 | Hotzel .................. A61K 45/06 |
| 2017/0114135 | A1* | 4/2017 | Codarri-Deak ......... A61P 43/00 |
| 2017/0114151 | A1 | 4/2017 | Dimasi et al. |
| 2017/0210802 | A1 | 7/2017 | Gauthier et al. |
| 2017/0218091 | A1 | 8/2017 | Ambrosi |
| 2017/0349669 | A1* | 12/2017 | Imhof-Jung ............ A61P 37/06 |

(Continued)

FOREIGN PATENT DOCUMENTS

| | | |
|---|---|---|
| EP | 0812357 B1 | 1/2007 |
| EP | 2509997 B1 | 8/2017 |

(Continued)

OTHER PUBLICATIONS

Golay et al., J Immunol 196: 3199-211 (Year: 2016).*

(Continued)

*Primary Examiner* — Phuong Huynh
(74) *Attorney, Agent, or Firm* — LATHROP GPM LLP; James H. Velema, Esq.

(57) ABSTRACT

Binding proteins comprising a VL region paired with a VH region, and a CH1 region paired with a CL region, wherein the VL region and VH region comprise opposite charged mutations to facilitate pairing, and wherein the CH1 region and CL region comprise mutations to facilitate pairing, are provided. Binding proteins comprising one or more cysteine residues engineered into the VH/VL pair to form one or more disulfide bonds, are also provided. Multispecific binding proteins, nucleic acids encoding binding proteins and multispecific binding proteins, expression vectors, host cells, pharmaceutical composition and methods of treatment administering the binding proteins or multispecific binding proteins described herein are also provided.

15 Claims, 30 Drawing Sheets

Specification includes a Sequence Listing.

(56) References Cited

U.S. PATENT DOCUMENTS

| | | | |
|---|---|---|---|
| 2018/0177873 A1* | 6/2018 | Carter | A61K 39/39558 |
| 2018/0201693 A1 | 7/2018 | Hibbert et al. | |
| 2019/0309092 A1 | 10/2019 | Hu et al. | |
| 2019/0382475 A1* | 12/2019 | Cebe | C07K 16/28 |

FOREIGN PATENT DOCUMENTS

| | | | |
|---|---|---|---|
| EP | 3299391 A1 | 3/2018 | |
| WO | WO 1999/037791 A1 | 7/1999 | |
| WO | WO 2003/012069 A2 | 2/2003 | |
| WO | WO 2005092925 A1 | 10/2005 | |
| WO | WO 2006/106905 A1 | 10/2006 | |
| WO | WO 2007147901 A1 | 12/2007 | |
| WO | WO 2009089004 A1 | 7/2009 | |
| WO | WO 2010021697 A2 | 2/2010 | |
| WO | WO 2011090754 A1 | 7/2011 | |
| WO | WO 2011118739 A1 | 9/2011 | |
| WO | WO 2011156328 A1 | 12/2011 | |
| WO | WO 2012131555 A2 | 10/2012 | |
| WO | WO 2012135345 A2 | 10/2012 | |
| WO | WO 2012162583 A1 | 11/2012 | |
| WO | WO 2013005194 A2 | 1/2013 | |
| WO | WO 2013065708 A2 | 5/2013 | |
| WO | WO 2014/081955 A1 | 5/2014 | |
| WO | WO 2014/082179 A1 | 6/2014 | |
| WO | WO 2014/106015 A2 | 7/2014 | |
| WO | WO 2014/116846 A2 | 7/2014 | |
| WO | WO 2014/124326 A1 | 8/2014 | |
| WO | WO 2015173756 A2 | 11/2015 | |
| WO | WO 2015/197598 A2 | 12/2015 | |
| WO | WO 2015181805 A1 | 12/2015 | |
| WO | WO 2016116626 A1 | 7/2016 | |
| WO | WO 2017005649 A1 | 1/2017 | |
| WO | WO 2017/049139 A2 | 3/2017 | |
| WO | WO 2017/079768 A1 | 5/2017 | |
| WO | WO 2017162890 A1 | 9/2017 | |
| WO | WO 2017180913 A2 | 10/2017 | |
| WO | WO-2017180913 A2 * | 10/2017 | A61K 39/3955 |
| WO | WO 2017186950 A1 | 11/2017 | |
| WO | WO 2018/017863 A1 | 1/2018 | |
| WO | WO 2018/035084 A1 | 2/2018 | |
| WO | WO 2018/037092 A1 | 3/2018 | |
| WO | WO 2018/075692 A2 | 4/2018 | |
| WO | WO 2018127608 A1 | 7/2018 | |
| WO | WO 2018/158719 A1 | 9/2018 | |

OTHER PUBLICATIONS

Lewis et al., Nat Biotechnology 32: 191-198 (Year: 2014).*
Lloyd et al. Protein Engineering, Design & Selection 22:159-168 (Year: 2009).*
Edwards et al., J Mol Biol. 334(1): 103-118 (Year: 2003).*
Piche-Nicholas et al MABS 10(1): 81-94 (Year: 2018).*
Briney et al., Nature 566: 393 (Year: 2019).*
Spiess et al., Molecular Immunology 67: 95-106 (Year: 2015).*
European Search Report received for European Application No. 18306843.6, dated Jun. 19, 2019, 7 Pages.
Golay, et al. (Apr. 1, 2016) "Design and Validation of a Novel Generic Platform for the Production of Tetravalent IgG1-like Bispecific Antibodies", The Journal of Immunology, vol. 196, No. 7, XP055396269, pp. 3199-3211.
International Search Report and Written Opinion for PCT International Patent Application No. PCT/IB2019/061309 dated Jun. 3, 2020, 14 pages.
Lewis et al. (Feb. 2014) "Generation of bispecific IgG antibodies by structure-based design of an orthogonal Fab interface", Nature Biotechnology, vol. 32, No. 2, pp. 191-202.
Liu et al. (Mar. 20, 2015) "A Novel Antibody Engineering Strategy for Making Monovalent Bispecific Heterodimeric IgG Antibodies by Electrostatic Steering Mechanism", The Journal of Biological Chemistry, vol. 290, No. 12, pp. 7535-7562.
MacCallum, et al. (Oct. 11, 1996) "Antibody-Antigen Interactions: Contact Analysis and Binding Site Topography", Journal of molecular biology, vol. 262, No. 5, pp. 732-745.
Martin, Andrew C.R. (2010) "Protein Sequence and Structure Analysis of Antibody Variable Domains", Chapter 3 of Antibody Engineering, vol. 2, Kontermann and Dubel Eds., Springer-Verlag, pp. 33-51.
Mazor et al. (Mar. 2015) "Improving target cell specificity using a novel monovalent bispecific IgG design", mAbs, vol. 7, No. 2, pp. 377-389.
Padlan, et al. (Jan. 1995) "Identification of Specificity-Determining Residues in Antibodies", The FASEB Journal, vol. 9, No. 1, pp. 133-139.
Reiter, et al. (Oct. 1996) "Engineering Antibody Fv Fragments for Cancer Detection and Therapy: Disulfide-Stabilized Fv Fragments", Nature Biotechnology, vol. 14, No. 10, pp. 1239-1245.
Tan, et al. (Sep. 1998) "Contributions of a Highly Conserved VH/VL Hydrogen Bonding Interaction to scFv Folding Stability and Refolding Efficiency", Biophysical Journal, vol. 75, No. 3, pp. 1473-1482.

* cited by examiner

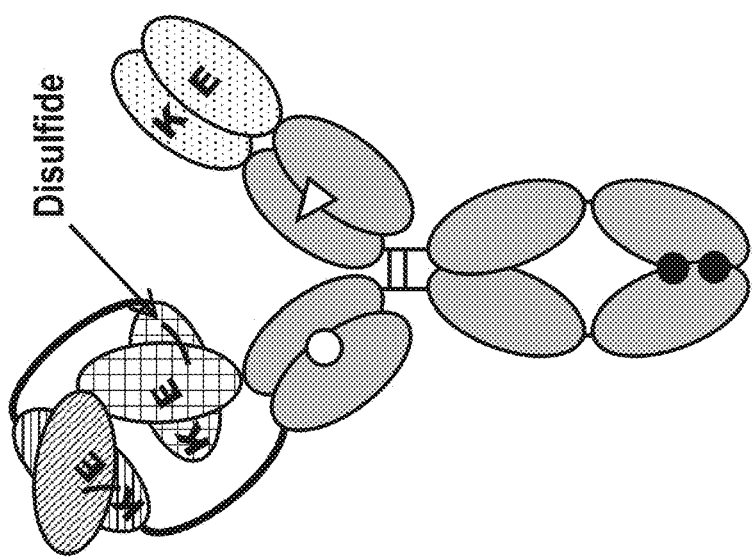
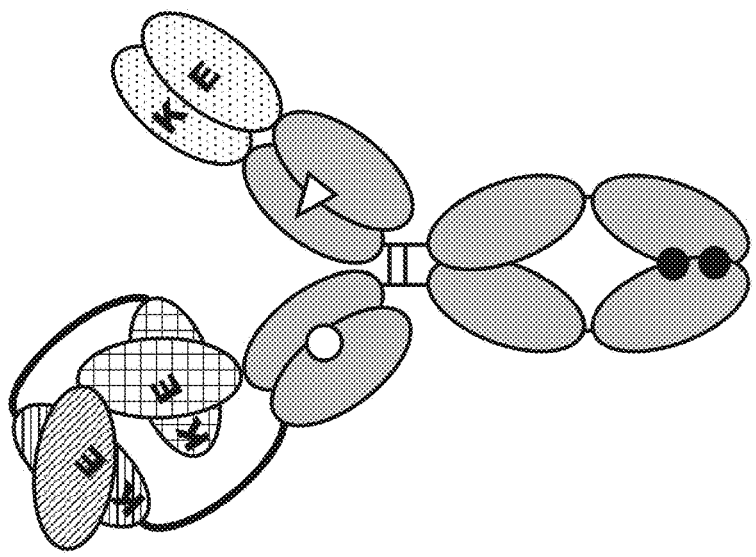
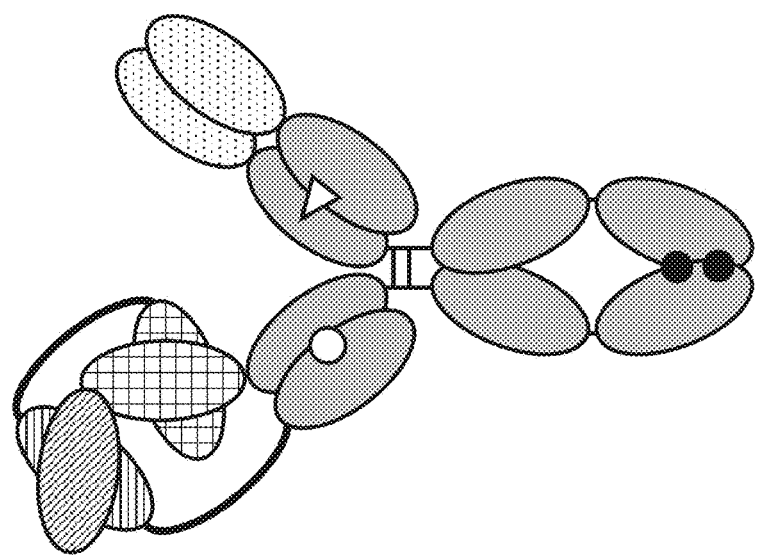
Fig. 1C
Fig. 1B
Fig. 1A

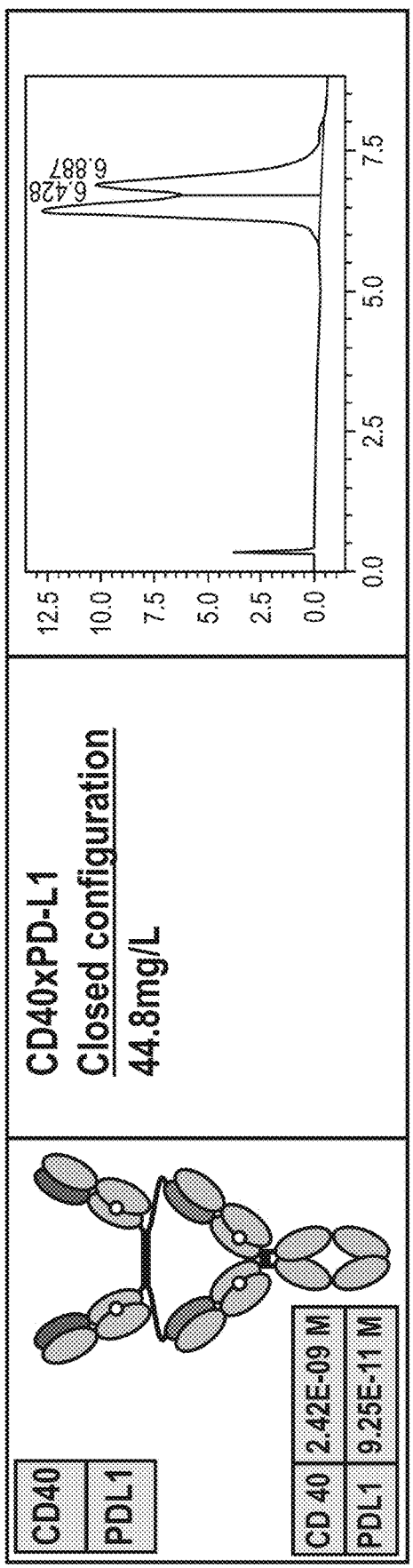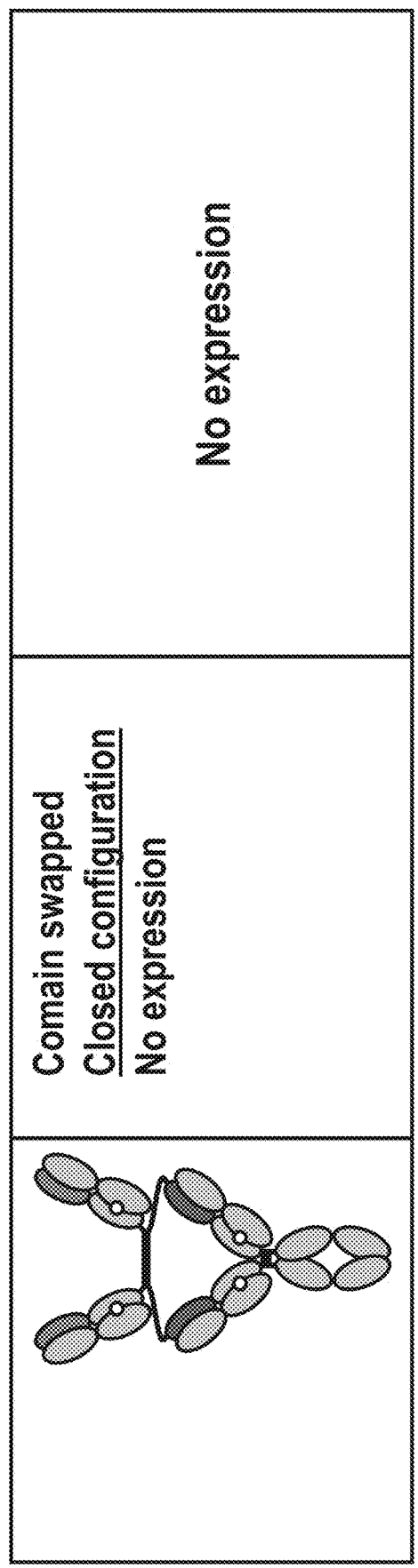
Fig. 5A
Fig. 5B

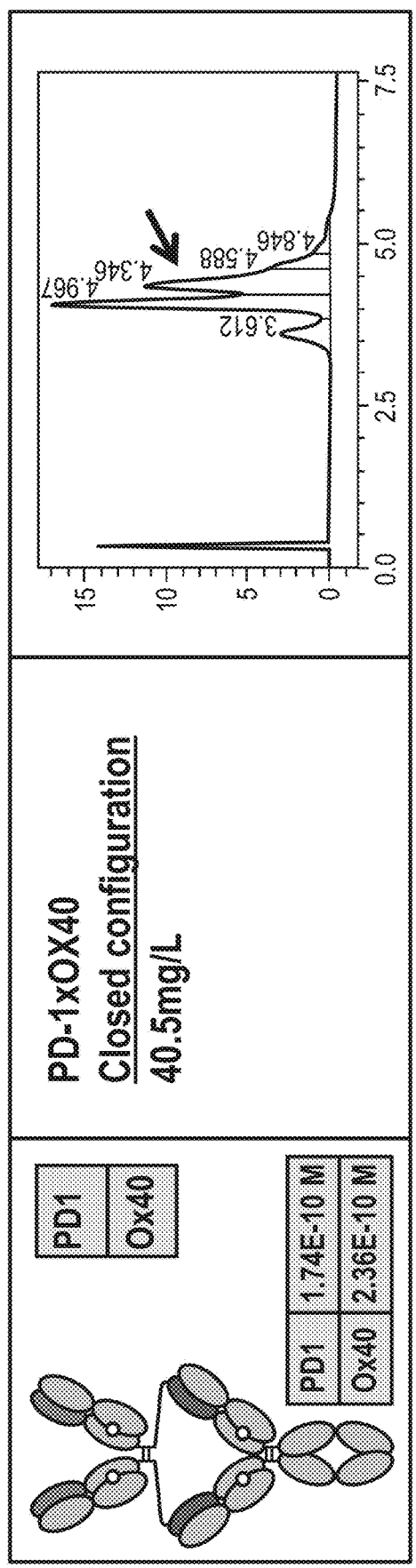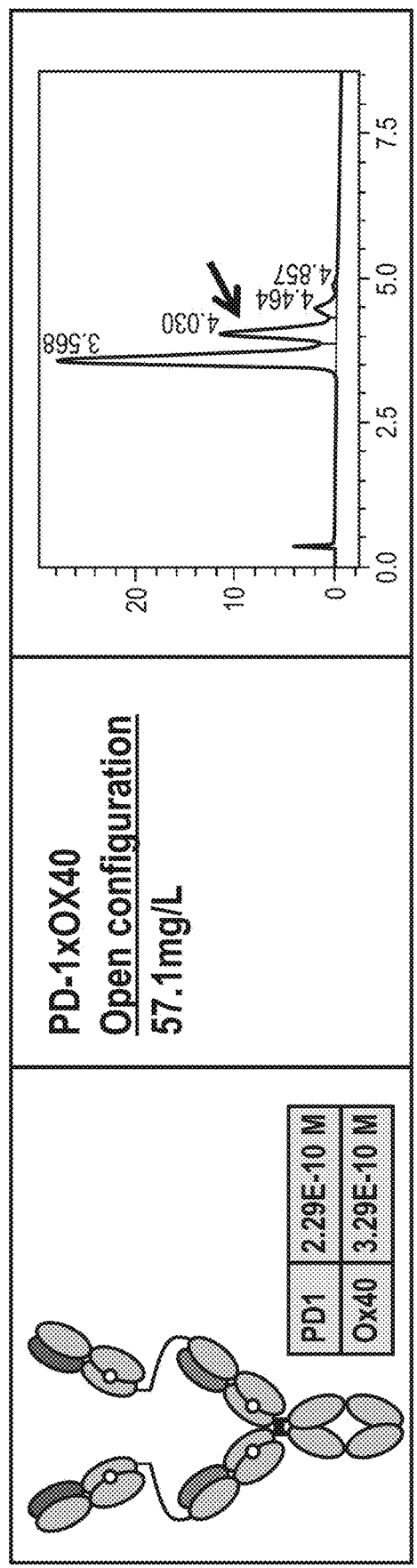
Fig. 6A
Fig. 6B

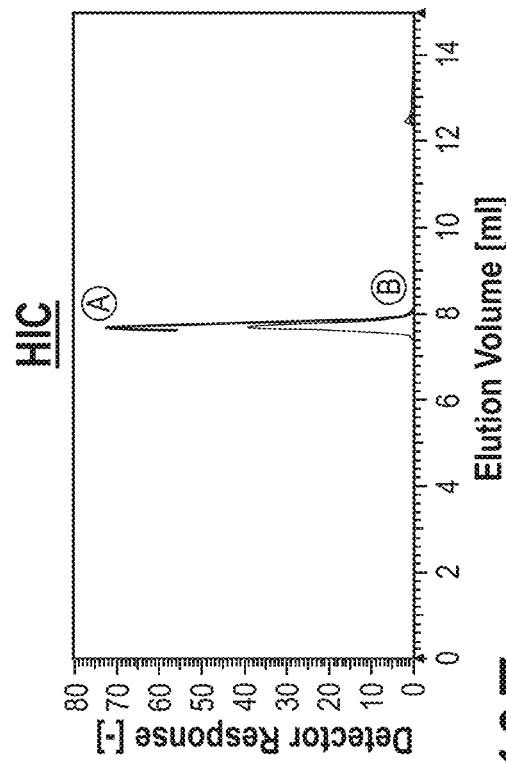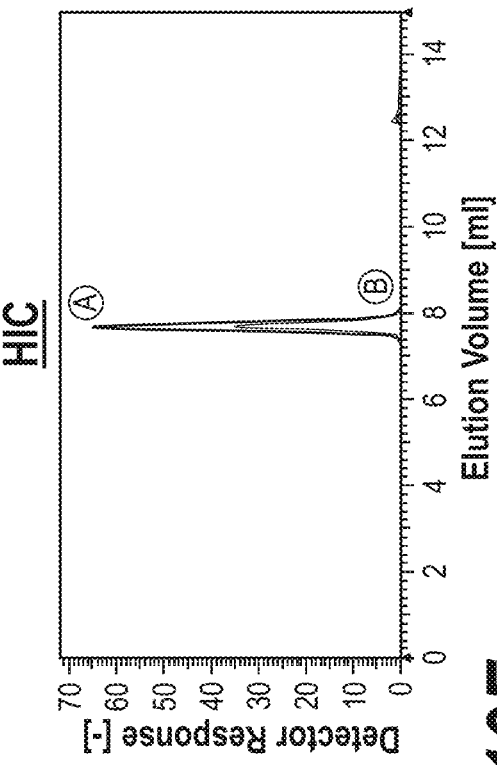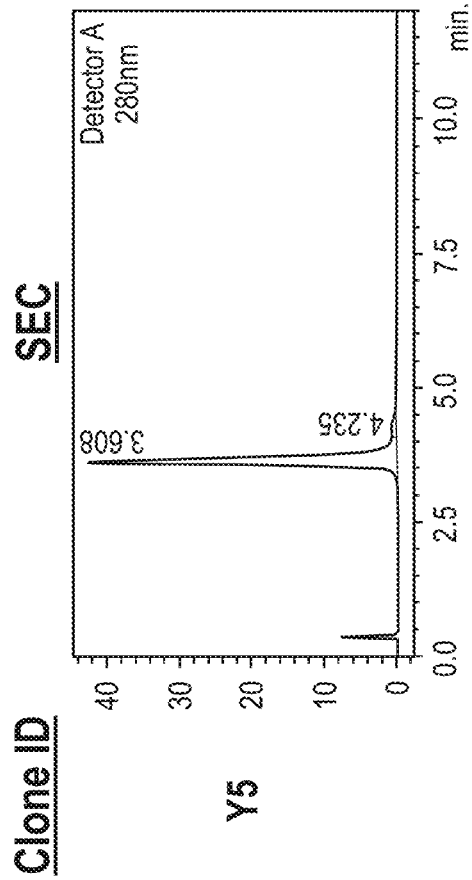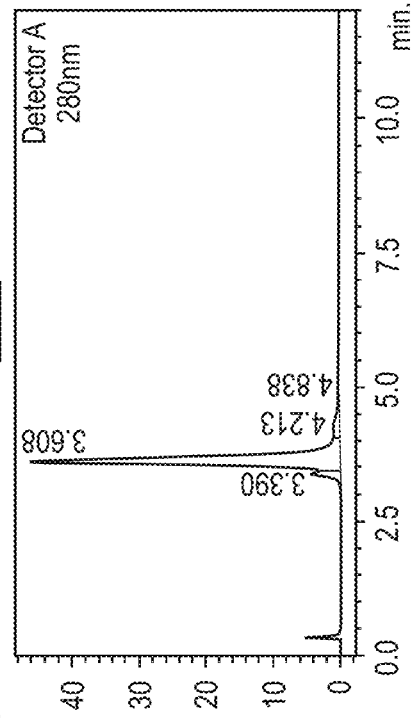
Fig. 10E
Fig. 10F

MULTISPECIFIC BINDING PROTEINS WITH MUTANT FAB DOMAINS

RELATED APPLICATIONS

The instant application claims priority to EP Application No. 18306843.6, filed Dec. 24, 2018, and EP Application No. 19305812.0, filed Jun. 21, 2019, the contents of which are incorporated herein by reference for all purposes.

SEQUENCE LISTING

The instant application contains a Sequence Listing which has been submitted electronically in ASCII format and is hereby incorporated by reference in its entirety. Said ASCII copy, created on May 4, 2020, is named 617911_SA9-243_ST25.txt and is 1,094,493 bytes in size.

BACKGROUND

Classical antibodies are Y-shaped proteins or immunoglobulins which are heterotetramers formed of two heterodimers, consisting of a light chain portion and a heavy chain portion. The "arms" of the antibody comprise an antigen-binding site and are called a Fab region. Classical antibodies (e.g., those produced by a host immune system) have two identical Fabs and can recognize and bind a specific antigen. The creation of asymmetry in a native antibody structure is a prerequisite for the generation of multispecific binding proteins having two (e.g., bispecific antibodies) or more binding specificities. For example, by separating one or more Fvs on different asymmetric binding arms or Fabs, a bispecific antibody can be made with the flexibility of binding two different antigens simultaneously. Despite these advantages, however, a wide variety of multispecific antibody technologies suffer process and manufacturing problems due to mispairings of various asymmetric heavy and light chains. For example, many of these technologies suffer from the so-called "light-chain problem", wherein random pairing of the two different light chains with heavy chains generates various combinations of chain pairings other than the desired combination. In some cases, the light-chain problem can be circumvented by the use of a common light chain, which enables binding to both antigens. However, this might not be possible for many antibodies since this format requires de novo antibody generation in transgenic mice or by display technologies. Furthermore, rare antibodies like broadly neutralizing anti-HIV antibodies derived from human patients cannot be adapted to such a format. Accordingly, there remains a need for alternative and creative solutions to the mispairing problem. Series of mutations in the dimer interface have been carefully designed to enable heterodimerization of these antibodies.

SUMMARY OF THE INVENTION

The present disclosure provides antigen-binding proteins that may optionally comprise a variety of mutations along a dimer interface that enable efficient heterodimerization of the antigen-binding proteins.

In one aspect, the present disclosure provides an antigen-binding protein comprising
a VL region paired with a VH region to form an antigen-binding site; and
a CH1 region paired with a CL region,
wherein the VL region and VH region comprise opposite charged mutations to facilitate pairing, and wherein the CH1 region and CL region comprise mutations to facilitate pairing.

In some embodiments, the antigen-binding protein further comprises a second VL region paired with a second VH region to form a second antigen-binding site; and a second CH1 region paired with a second CL region.

In some embodiments, one or both of the first VH and VL pair and the second VH and VL pair comprise opposite charged mutations to facilitate pairing, and one or both of the first CH1 and CL pair and the second CH1 and CL pair comprise mutations to facilitate pairing.

In some embodiments, one or both CH1 regions comprise a T192E mutation and one or both CL regions comprise N137K and S114A mutations.

In some embodiments, one or both CH1 regions comprise L143Q and S188V mutations and one or both CL regions comprise V133T and S176V mutations.

In some embodiments, one or both CH1 regions comprise T192E, L143Q and S188V mutations and one or both CL regions comprise N137K, S114A, V133T and S176V mutations.

In some embodiments, one or both CH1 regions comprise a L143E, L143D, L143K, L143R, or L143H mutation and one or both CL regions comprise a S176E, S176D, S176K, S176R, or S176H mutation, wherein the mutation in CH1 is an opposite charge from the mutation in CL.

In some embodiments, one or both CH1 regions comprise a L124E, L124D, L124K, L124R, or L124H mutation and one or both CL regions comprise a V133E, V133D, V133K, V133R, or V133H mutation, wherein the mutation in CH1 is an opposite charge from the mutation in CL.

In some embodiments, one or both VH regions comprise a 39E, 39D, 39K, 39R, or 39H mutation, and one or both VL regions comprise a 38E, 38D, 38K, 38R, or Q38H mutation, wherein the mutation in VH is an opposite charge from the mutation in VL.

In some embodiments, one or both VH regions comprise a Q39E, Q39D, Q39K, Q39R, or Q39H mutation, and one or both VL regions comprise a Q38E, Q38D, Q38K, Q38R, or Q38H mutation, wherein the mutation in VH is an opposite charge from the mutation in VL.

In some embodiments, the antigen-binding protein further comprises one or more cysteine residues engineered into one or both of the VHNL pairs to form one or more disulfide bonds.

In some embodiments, one or both VH regions comprise one or both of 44C and 105C mutations, and one or both VL regions comprise one or both of 100C and 43C mutations.

In some embodiments, one or both VH regions comprise a 44C mutation and one or both VL regions comprise a 100C mutation.

In some embodiments, one or both VH regions comprise a 105C mutation and one or both VL regions comprise a 43C mutation.

In some embodiments, the antigen-binding protein further comprises opposite charged mutations in one or both the CH1/CL pairs.

In some embodiments, the opposite charged mutations in one or both the CH1/CL pairs are selected from the group consisting of: K221E in the CH1 region and E123K in the CL region; K228D in the CH1 region and D122K in the CL region; L145E in the CH1 region and S176K in the CL region; and L128E in the CH1 region and V133K in the CL region.

In another aspect, the present disclosure provides a multispecific antigen-binding protein comprising at least two VL regions respectively paired with at least two VH regions to form at least two antigen-binding sites and at least two CH1 regions respectively paired with two CL regions, wherein at least one CH1/CL pair comprises CH1/CL mutations to facilitate pairing selected from:
(1) T192E (CH1) mutation and N137K and S114A (CL) mutations, and/or
(2) L143Q and S188V (CH1) mutations, and V133T and S176V (CL) mutations, and/or
(3) T192E, L143Q and S188V (CH1) mutations and N137K, S114A, V133T and S176V (CL) mutations, and/or
(4) K221E (CH1) mutation and E123K (CL) mutation, and/or
(5) T192E and K221E (CH1) mutation and N137K, S114A and E123K (CL) mutations and/or
(6) L143E, L143D, L143K, L143R, or L143H (CH1) mutation and S176E, S176D, S176K, S176R, or S176H (CL) mutation, and/or
(7) L124E, L124D, L124K, L124R, or L124H (CH1) mutation and V133E, V133D, V133K, V133R, or V133H (CL) mutation, and
(8) wherein when two CH1/CL pairs comprise mutations to facilitate pairing for two different VH/VL pairs, the two CH1/CL pairs do not comprise same mutations, and wherein at least one VH/VL pair comprise opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region.

In another aspect, the present disclosure provides a multispecific antigen-binding protein comprising at least two VL regions respectively paired with at least two VH regions to form at least two antigen-binding sites and at least two CH1 regions respectively paired with two CL regions,
wherein at least one CH1/CL pair comprises CH1/CL mutations to facilitate pairing selected from the group consisting of one or more of
(1) a T192E (CH1) mutation and N137K and S114A (CL) mutations, and
(2) L143Q and S188V (CH1) mutations, and V133T and S176V (CL) mutations, and
(3) T192E, L143Q and S188V (CH1) mutations and N137K, S114A, V133T and S176V (CL) mutations,
(4) a K221E (CH1) mutation and a E123K (CL) mutation,
(5) T192E and K221E (CH1) mutations and N137K, S114A and E123K (CL) mutations,
(6) a L143E, a L143D, a L143K, a L143R, or a L143H (CH1) mutation and a S176E, a S176D, a S176K, a S176R, or a S176H (CL) mutation,
(7) a L124E, a L124D, a L124K, a L124R, or a L124H (CH1) mutation and a V133E, a V133D, a V133K, a V133R, or a V133H (CL) mutation,
(8) a K228D (CH1) mutation and a D122K (CL) mutation, and
(9) K221E and K228D (CH1) mutations and D122K and E123K (CL) mutations,
wherein when two CH1/CL pairs comprise mutations to facilitate pairing for two different VHnL pairs, the two CH1/CL pairs do not comprise same mutations, and wherein at least one VHNL pair comprise opposite site charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region.

In some embodiments, in the multispecific antigen-binding protein, when at least two different VHNL pairs comprise a mutation set to facilitate pairing, then the at least two different VHNL pairs do not comprise the same mutation set.

In some embodiments, a multispecific antigen-binding protein comprises at least two VL regions respectively paired with at least two VH regions to form at least two antigen-binding sites and at least two CH1 regions respectively paired with two CL regions,
wherein at least one CH1/CL pair comprise CH1/CL mutations to facilitate pairing selected from the group consisting of one or more of:
(1) T192E (CH1) mutation and N137K and S114A (CL) mutations, and/or
(2) L143Q and S188V (CH1) mutations, and V133T and S176V (CL) mutations, and/or
(3) T192E, L143Q and S188V (CH1) mutations and N137K, S114A, V133T and S176V (CL) mutations, and/or
(4) K221E (CH1) mutation and E123K (CL) mutation, and/or
(5) L143E, L143D, L143K, L143R, or L143H (CH1) mutation and S176E, S176D, S176K, S176R, or S176H (CL) mutation, and/or
(6) L124E, L124D, L124K, L124R, or L124H (CH1) mutation and V133E, V133D, V133K, V133R, or V133H (CL) mutation, and
(7) when two CH1/CL pairs comprise mutations to facilitate pairing for two different VHNL pairs, the two CH1/CL pairs do not comprise same mutations, and
wherein at least one VHNL pair comprise opposite charged mutations to facilitate pairing selected from 39E, Q39D, Q39K, Q39R, or Q39H mutation, and Q38E, Q38D, Q38K, Q38R, or Q38H mutation, and wherein the mutation in VH is an opposite charge from the mutation in VL; and when several VHNL pairs, for which VL or VH are not in the same polypeptide chain, comprise mutations to facilitate pairing for different VHNL pairs, then each VHNL pair do not comprise same opposite charged mutations.

In some embodiments, one or both CH1 regions are operably linked to a heterodimerization domain.

In some embodiments, the heterodimerization domain comprises a first Fc domain.

In some embodiments, the first Fc domain heterodimerizes with a second Fc domain, and wherein the first Fc domain comprises a first CH3 region and the second Fc domain comprises a second CH3 region.

In some embodiments, the first CH3 region comprises one or both of S354C and T366W mutations, and the second CH3 region comprises one or more of Y349C, T366S, L368A, and Y407V mutations, wherein the mutations facilitate Fc domain heterodimerization.

In another aspect, the present disclosure provides a multispecific antibody comprising a) a first light chain (LC1)/heavy chain (HC1) pair comprising
  (1) a first VL region (VL1) paired with first VH region (VH1) to form a first antigen-binding site;
  (2) a first constant heavy chain region 1 (CH1-1) and a first constant light chain region (CL1); and
  (3) a first heterodimerization domain (HD1); and
b) a second light chain (LC2)/heavy chain (HC2) pair comprising
  (4) a second VL region (VL2) paired with a second VH region (VH2) to form a second antigen-binding site;
  (5) a second constant heavy chain region 1 (CH1-2) and a second constant light chain region (CL2); and
  (6) a second heterodimerization domain (HD2);
wherein HD1 and HD2 heterodimerize,
wherein at least one or both of VL1 and VH1 pair and of VL2 and VH2 pair comprise opposite charged mutations to facilitate pairing,
wherein at least one or both of CL1 and CH1-1 pair and of CL2 and CH1-2 pair comprise mutations to facilitate pairing, and
wherein when both of CL1 and CH1-1 pair and of CL2 and CH1-2 pair comprise mutations to facilitate pairing, the mutations in CH1-1 and CL1 to facilitate pairing are different from the mutations in CH1-2 and CL2 to facilitate pairing.

In another aspect, the present disclosure provides a multispecific antibody comprising:
a) a first light chain (LC1)/heavy chain (HC1) pair comprising
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1; and
  (3) a first heterodimerization domain (HD1); and
b) a second light chain (LC2)/heavy chain (HC2) pair comprising
  (4) a second VL region (VL2) paired with a second VH region (VH2) to form a second antigen-binding site;
  (5) a second constant heavy chain region 1 (CH1-2) operatively linked to VH2 and a second constant light chain region (CL2) operatively linked to VL2; and
  (6) a second heterodimerization domain (HD2);
wherein HD1 and HD2 heterodimerize,
wherein at least one or both of VL1 and VH1 pair and of VL2 and VH2 pair comprise opposite charged mutations to facilitate pairing,
wherein at least one or both of CL1 and CH1-1 pair and of CL2 and CH1-2 pair comprise mutations to facilitate pairing, and
wherein when both of CL1 and CH1-1 pair and of CL2 and CH1-2 pair comprise mutations to facilitate pairing, the mutations in CH1-1 and CL1 to facilitate pairing are different from the mutations in CH1-2 and CL2 to facilitate pairing.

In another aspect, the present disclosure provides a multispecific antigen-binding protein comprising:
a) a first light chain (LC1)/heavy chain (HC1) pair comprising
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1; and
  (3) a first heterodimerization domain (HD1); and
b) a second light chain (LC2)/heavy chain (HC2) pair comprising
  (4) a second VL region (VL2) paired with a second VH region (VH2) to form a second antigen-binding site;
  (5) a second constant heavy chain region 1 (CH1-2) operatively linked to VH2 and a second constant light chain region (CL2) operatively linked to VL2; and (6) a second heterodimerization domain (HD2);
wherein HD1 and HD2 heterodimerize,
wherein at least one or both of VL1 and VH1 pair and of VL2 and VH2 pair comprises opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region,
wherein at least one or both of CL1 and CH1-1 pair and of CL2 and CH1-2 pair comprises mutations to facilitate pairing, and
wherein when both of CL1 and CH1-1 pair and of CL2 and CH1-2 pair comprise mutations to facilitate pairing, the mutations in CH1-1 and CL1 to facilitate pairing are different from the mutations in CH1-2 and CL2 to facilitate pairing.

In some embodiments, CH1-1 comprises a T192E mutation and CL1 comprises N137K and S114A mutations.

In some embodiments, CH1-1 comprises L143Q and S188V mutations and CL1 comprises V133T and S176V mutations.

In some embodiments, CH1-1 comprises T192E, L143Q and S188V mutations and CL1 comprises N137K, S114A, V133T and S176V mutations.

In some embodiments, CH1-2 comprises a T192E mutation and CL2 comprises N137K and S114A mutations.

In some embodiments, CH1-2 comprises L143Q and S188V mutations and CL2 comprises V133T and S176V mutations.

In some embodiments, CH1-2 comprises T192E, L143Q and S188V mutations and CL2 comprises N137K, S114A, V133T and S176V mutations.

In some embodiments, one of both of CH1-1 and CH1-2 comprises a L143E, L143D, L143K, L143R, or L143H mutation and one or both of CL1 and CL2 comprises a S176E, S176D, S176K, S176R, or S176H mutation, wherein the mutation in one of both of CH1-1 or CH1-2 is an opposite charge from the mutation in one or both of CL1 and CL2.

In some embodiments, one of both of CH1-1 and CH1-2 comprises a L124E, L124D, L124K, L124R, or L124H mutation and one or both of CL1 and CL2 comprises a V133E, V133D, V133K, V133R, or V133H mutation, wherein the mutation in one of both of CH1-1 or CH1-2 is an opposite charge from the mutation in one or both of CL1 and CL2

In some embodiments, one or both of VH1 and VH2 comprises a 39E, 39D, 39K, 39R, or 39H mutation, and one or both of VL1 and VL2 comprises a 38E, 38D, 38K, 38R, or 38H mutation, wherein the mutation in one or both of VH1 and VH2 is an opposite charge from the mutation in one or both of VL1 and VL2.

In some embodiments, one or both of VH1 and VH2 comprises a Q39E, Q39D, Q39K, Q39R, or Q39H mutation, and one or both of VL1 and VL2 comprises a Q38E, Q38D, Q38K, Q38R, or Q38H mutation, wherein the mutation in one or both of VH1 and VH2 is an opposite charge from the mutation in one or both of VL1 and VL2.

In some embodiments, the multispecific antibody further comprises one or more cysteine residues engineered into the one or both of VH1NL1 and VH2NL2 pairs to form one or more disulfide bonds.

In some embodiments, one or both of VH1 and VH2 comprises 44C and 105C mutations, and one or both of VL1 and VL2 comprises 100C and 43C mutations.

In some embodiments, VH1 comprises a 44C mutation and VL1 comprises a 100C mutation.

In some embodiments, VH1 comprises a 105C mutation and VL1 comprises a 43C mutation.

In some embodiments, VH2 comprises a 44C mutation and VL2 comprises a 100C.

In some embodiments, VH2 comprises a 105C mutation and VL2 comprises a 43C mutation.

In some embodiments, VH1 comprises 39E and 44C mutations and VL1 comprises 38K and 100C mutations.

In some embodiments, VH1 comprises 39E and 105C mutations and VL1 comprises 38K and 43C mutations.

In some embodiments, the multispecific antibody further comprises opposite charged mutations in the CH1-1/CL1 pair.

In some embodiments, the opposite charged mutations in the CH1-1/CL1 pair are selected from the group consisting of: K221E in the CH1-1 region and E123K in the CL1 region; K228D in the CH1-1 region and D122K in the CL1 region; L145E in the CH1-1 region and S176K in the CL1 region; and L128E in the CH1-1 region and V133K in the CL1 region.

In some embodiments, the multispecific antibody further comprises opposite charged mutations in the CH1-2/CL2 pair.

In some embodiments, the opposite charged mutations in the CH1-2/CL2 pair are selected from the group consisting of: K221E in the CH1-2 region and E123K in the CL2 region; K228D in the CH1-2 region and D122K in the CL2 region; L145E in the CH1-2 region and S176K in the CL2 region; and L128E in the CH1-2 region and V133K in the CL2 region.

In some embodiments, the first and second heterodimerization domains comprise Fc domains.

In some embodiments, the first heterodimerization domain comprises a first CH3 domain comprising one or both of S354C and T366W mutations, and the second heterodimerization domain comprises a second CH3 domain comprising one or both of Y349C, T366S, L368A, and Y407V mutations, wherein the mutations facilitate Fc domain heterodimerization.

In some embodiments, the CH1-1 domain is linked to a first CH2 and first CH3 domain, the CH1-2 domain is linked to a second CH2 and second CH3 domain, and wherein the first CH2 and CH3 domains and the second CH2 and CH3 domains dimerize to form an Fc domain.

In some embodiments, the first CH3 domain comprises one or both of S354C and T366W mutations, the second CH3 domain comprises one or more of Y349C, T366S, L368A, and Y407V mutations, and wherein the mutations facilitate Fc domain heterodimerization.

In another aspect, the present disclosure provides an antigen-binding protein or a multispecific antigen-binding protein comprising at least two polypeptide chains and forming at least two antigen-binding sites, wherein one polypeptide chain comprises a structure represented by the formula:

VL1-L1-VL2-L2-CL  [I]

and one polypeptide chain comprises a structure represented by the formula:

VH2-L3-VH1-L4-CH1  [II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain; and
L1, L2, L3, and L4 are amino acid linkers,
wherein the polypeptide of formula I and the polypeptide of formula II form a cross-over light chain-heavy chain pair,
wherein one or more cysteine residues are engineered into the one or both of VH1NL1 and VH2NL2 pairs to form one or more disulfide bonds,
wherein at least one or both of VL1 and VH1 pair and of VL2 and VH2 pair comprise opposite charged mutations that facilitate pairing, and
wherein the CH1 and CL domain pair comprise mutations that facilitate pairing.

In some embodiments, VH1 is paired with VL1, VH2 is paired with VL2, and CH1 is paired with CL.

In some embodiments, the present disclosure provides a multispecific antigen-binding protein comprising at least two polypeptide chains and forming at least two antigen-binding sites, wherein one polypeptide chain comprises a structure represented by the formula:

VL1-L1-VL2-L2-CL  [I]

and one polypeptide chain comprises a structure represented by the formula:

VH2-L3-VH1-L4-CH1  [II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain; and
L1, L2, L3, and L4 are amino acid linkers,
wherein VH1 is paired with VL1, VH2 is paired with VL2, and CH1 is paired with CL,
wherein the polypeptide of formula I and the polypeptide of formula II form a cross-over light chain-heavy chain pair,
wherein one or more cysteine residues are engineered into the one or both of VH1NL1 and VH2NL2 pairs to form one or more disulfide bonds,
wherein at least one or both of VL1 and VH1 pair and of VL2 and VH2 pair comprises opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region, and wherein the CH1 and CL domain pair comprise mutations that facilitate pairing.

In some embodiments, one or both of VH1 and VH2 comprise VH44C and VH105C mutations.

In some embodiments, one or both of VL1 and VL2 comprise VL43C and VL100C mutations.

In some embodiments, one or both of VH1 and VH2 comprise a VH44C mutation and one or both of VL1 and VL2 comprise a VL100C mutation.

In some embodiments, one or both of VH1 and VH2 comprise a VH105C mutation and one or both of VL1 and VL2 comprise a VL43C mutation.

In some embodiments, CH1 comprises a T192E mutation and CL comprises N137K and S114A mutations.

In some embodiments, CH1 comprises L143Q and S188V mutations and CL comprises V133T and S176V mutations.

In some embodiments, CH1 comprises T192E, L143Q and S188V mutations and CL comprises N137K, S114A, V133T and S176V mutations.

In some embodiments, CH1 comprises a L143E, a L143D, a L143K, a L143R, or a L143H mutation, CL comprises a S176E, a S176D, a S176K, a S176R, or a S176H mutation, and wherein the mutation in CH1 is an opposite charge from the mutation in CL.

In some embodiments, CH1 comprises a L124E, a L124D, a L124K, a L124R, or a L124H mutation, CL comprises a V133E, a V133D, a V133K, a V133R, or a V133H mutation, and wherein the mutation in CH1 is an opposite charge from the mutation in CL.

In some embodiments, one or both of VH1 and VH2 comprises a 39E, a 39D, a 39K, a 39R, or a 39H mutation, one or both of VL1 and VL2 comprises a 38E, a 38D, a 38K, a 38R, or a 38H mutation, and wherein the mutation in one or both of VH1 and VH2 is an opposite charge from the mutation in one or both of VL1 and VL2.

In some embodiments, one or both of VH1 and VH2 comprises a Q39E, a Q39D, a Q39K, a Q39R, or a Q39H mutation, one or both of VL1 and VL2 comprises a Q38E, a Q38D, a Q38K, a Q38R, or a Q38H mutation, and wherein the mutation in one or both of VH1 and VH2 is an opposite charge from the mutation in one or both of VL1 and VL2.

In some embodiments, CH1 is operatively linked to a dimerization domain.

In some embodiments, the dimerization domain is an Fc domain comprising a CH2 domain and a CH3 domain.

In another aspect, the present disclosure provides a multispecific antigen-binding protein comprising four polypeptide chains that form four antigen-binding sites, wherein two polypeptide chains each comprises a structure represented by the formula:

VL1-L1-VL2-L2-CL　　　　[I]

and two polypeptide chains each comprises a structure represented by the formula:

VH2-L3-VH1-L4-CH1-Fc　　　　[II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain;
Fc comprises an immunoglobulin hinge region and CH2 and CH3 immunoglobulin heavy chain constant domains; and
L1, L2, L3, and L4 are amino acid linkers,
wherein VH1 is paired with VL1 to form a first antigen-binding site, VH2 is paired with VL2 to form a second antigen-binding site, and CH1 is paired with CL,
wherein the polypeptides of formula I and the polypeptides of formula II form a cross-over light chain-heavy chain pair,
wherein one or more cysteine residues are engineered into the one or both of VH1/VL1 and VH2/VL2 pairs to form one or more disulfide bonds,
wherein one or both of the VL1 and VH1 pair and the VL2 and VH2 pair comprise opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region, and
wherein one or both of the CH1 and CL domain pair comprises mutations that facilitate pairing, and
wherein when at least two CH1/CL pairs comprise mutations to facilitate pairing, then the mutation set in one CH1/CL pair is different from the mutation set in the other CH1/CL pair.

In another aspect, the present disclosure provides an antigen-binding protein comprising four polypeptide chains that form four antigen-binding sites, wherein two polypeptide chains each comprises a structure represented by the formula:

VL1-L1-VL2-L2-CL　　　　[I]

and two polypeptide chains each comprises a structure represented by the formula:

VH2-L3-VH1-L4-CH1-Fc　　　　[II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain;
Fc comprises an immunoglobulin hinge region and CH2 and CH3 immunoglobulin heavy chain constant domains; and
L1, L2, L3, and L4 are amino acid linkers,
wherein the polypeptides of formula I and the polypeptides of formula II form a cross-over light chain-heavy chain pair,
wherein VH1 is paired with VL1 to form a first antigen-binding site, VH2 is paired with VL2 to form a second antigen-binding site, and CH1 is paired with CL, and more particularly the VH1NL1 pair comprises a first antigen binding specificity and the VH2NL2 pair comprises a second antigen binding specificity, wherein one or more cysteine residues are engineered into the one or both of VH1NL1 and VH2NL2 pairs to form one or more disulfide bonds, wherein one or both of the VL1 and VH1 pair and the VL2 and VH2 pair comprise opposite charged mutations that facilitate pairing, and wherein one or both of the CH1 and CL domain pair comprises mutations that facilitate pairing, and wherein when both CH1 and CL pairs comprise mutations to facilitate pairing, then the mutations in one CH1 and CL pair are different from the mutations in the other CH1 and CL pair to facilitate pairing.

In some embodiments, one or both of VH1 and VH2 comprise VH44C and VH105C mutations.

In some embodiments, one or both of VL1 and VL2 comprise VL43C and VL100C mutations.

In some embodiments, one or both of VH1 and VH2 comprise a VH44C mutation and one or both of VL1 and VL2 comprise a VL100C mutation.

In some embodiments, one or both of VH1 and VH2 comprise a VH105C mutation and one or both of VL1 and VL2 comprise a VL43C mutation.

In some embodiments, CH1 comprises a T192E mutation and CL comprises N137K and S114A mutations.

In some embodiments, CH1 comprises L143Q and S188V mutations and CL comprises V133T and S176V mutations.

In some embodiments, CH1 comprises T192E, L143Q and S188V mutations and CL comprises N137K, S114A, V133T and S176V mutations.

In some embodiments, CH1 comprises a L143E, a L143D, a L143K, a L143R, or a L143H mutation, CL comprises a S176E, a S176D, a S176K, a S176R, or a S176H mutations, and wherein the mutation in CH1 is an opposite charge from the mutation in CL.

In some embodiments, CH1 comprises a L124E, a L124D, a L124K, a L124R, or a L124H mutation, CL comprises a V133E, a V133D, a V133K, a V133R, or a V133H mutations, and wherein the mutation in CH1 is an opposite charge from the mutation in CL.

In some embodiments, one or both of VH1 and VH2 comprises a 39E, a 39D, a 39K, a 39R, or a 39H mutation, one or both of VL1 and VL2 comprises a 38E, a 38D, a 38K, a 38R, or a 38H mutation, and wherein the mutation in one or both of VH1 and VH2 is an opposite charge from the mutation in one or both of VL1 and VL2.

In some embodiments, one or both of VH1 and VH2 comprises a Q39E, a Q39D, a Q39K, a Q39R, or a Q39H mutation, one or both of VL1 and VL2 comprises a Q38E, a Q38D, a Q38K, a Q38R, or a Q38H mutation, and wherein the mutation in one or both of VH1 and VH2 is an opposite charge from the mutation in one or both of VL1 and VL2.

In another aspect, the present disclosure provides a multispecific antigen-binding protein comprising four polypeptide chains, that form three antigen-binding sites, wherein a first polypeptide chain comprises a structure represented by the formula:

VL2-L1-VL1-L2-CL1 [I], a second polypeptide chain comprises a structure represented by the formula:

VH1-L3-VH2-L4-CH1-1-hinge-CH2-CH3 [II], a third polypeptide chain comprises a structure represented by the formula:

VH3-CH1-2-hinge-CH2-CH3 [III], and a fourth polypeptide chain comprises a structure represented by the formula:

VL3-CL2 [IV], wherein:
VL1 is a first immunoglobulin light chain variable domain;
VL2 is a second immunoglobulin light chain variable domain;
VL3 is a third immunoglobulin light chain variable domain;
VH1 is a first immunoglobulin heavy chain variable domain;
VH2 is a second immunoglobulin heavy chain variable domain;
VH3 is a third immunoglobulin heavy chain variable domain;
CL1 is a first immunoglobulin light chain constant domain;
CL2 is a second immunoglobulin light chain constant domain;
CH1-1 is a first immunoglobulin CH1 heavy chain constant domain;
CH1-2 is a second immunoglobulin CH1 heavy chain constant domain;
CH2 is an immunoglobulin CH2 heavy chain constant domain;
CH3 is an immunoglobulin CH3 heavy chain constant domain;
hinge is an immunoglobulin hinge region connecting the CH1 and CH2 domains; and L1, L2, L3, and L4 are amino acid linkers, wherein the polypeptide of formula I and the polypeptide of formula II form a cross-over light chain-heavy chain pair, and wherein one or more cysteine residues are engineered into the one or more of VH1NL1, VH2NL2, and VH3NL3 pairs to form one or more disulfide bonds, wherein one or both of the VL1 and VH1 pair and the VL2 and VH2 pair comprise opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region, wherein one or both of the CL1 and CH1-1 pair and the CL2 and CH1-2 pair comprise mutations that facilitate pairing, and wherein when both of CL1 and CH1-1 pair and of CL2 and CH1-2 pair comprise mutations to facilitate pairing, the mutations in CH1-1 and CL1 are different than the mutations in CH1-2 and CL2.

In some embodiments, one or both of VH1 and VH2 comprise VH44C and VH105C mutations.

In some embodiments, one or both of VL1 and VL2 comprise VL43C and VH1000 mutations.

In some embodiments, one or both of VH1 and VH2 comprise a VH44C mutation and one or both of VL1 and VL2 comprise a VL1000 mutation.

In some embodiments, one or both of VH1 and VH2 comprise a VH105C mutation and one or both of VL1 and VL2 comprise a VL43C mutation.

In some embodiments, one or both of CH1-1 and CL1 comprise mutations that facilitate pairing and one or both of CH1-2 and CL2 comprise mutations that facilitate pairing.

In some embodiments, CH1-1 comprises a T192E mutation and CL1 comprises N137K and S114A mutations.

In some embodiments, CH1-1 comprises L143Q and S188V mutations and CL1 comprises V133T and S176V mutations.

In some embodiments, CH1-1 comprises T192E, L143Q and S188V mutations and CL1 comprises N137K, S114A, V133T and S176V mutations.

In some embodiments, CH1-2 comprises a T192E mutation and CL2 comprises N137K and S114A mutations.

In some embodiments, CH1-2 comprises L143Q and S188V mutations and CL2 comprises V133T and S176V mutations.

In some embodiments, CH1-2 comprises a T192E, L143Q and S188V mutation and CL2 comprises N137K, S114A, V133T and S176V mutations.

In some embodiments, one of both of CH1-1 and CH1-2 comprises a L143E, a L143D, a L143K, a L143R, or a L143H mutation, one or both of CL1 and CL2 comprises a S176E, a S176D, a S176K, a S176R, or a S176H mutation, and wherein the mutation in one of both of CH1-1 or CH1-2 is an opposite charge from the mutation in one or both of CL1 and CL2.

In some embodiments, one of both of CH1-1 and CH1-2 comprises a L124E, a L124D, a L124K, a L124R, or a L124H mutation, one or both of CL1 and CL2 comprises a V133E, a V133D, a V133K, a V133R, or a V133H mutation, and wherein the mutation in one of both of CH1-1 or CH1-2 is an opposite charge from the mutation in one or both of CL1 and CL2.

In some embodiments, one or more of VH1, VH2, and VH3 comprises a 39E, a 39D, a 39K, a 39R, or a 39H mutation, one or more of VL1, VL2, and VL3 comprises a 38E, a 38D, a 38K, a 38R, or a 38H mutation, and wherein the mutation in one or more of VH1, VH2, and VH3 is an opposite charge from the mutation in one or more of VL1, VL2, and VL3.

In some embodiments, one or more of VH1, VH2, and VH3 comprises a Q39E, a Q39D, a Q39K, a Q39R, or a Q39H mutation, one or more of VL1, VL2, and VL3 comprises a Q38E, a Q38D, a Q38K, a Q38R, or a Q38H mutation, and wherein the mutation in one or more of VH1, VH2, and VH3 is an opposite charge from the mutation in one or more of VL1, VL2, and VL3.

In another aspect, the present disclosure provides a multispecific antigen-binding protein or antibody comprising:
 a) a first light chain (LC1)/heavy chain (HC1) pair comprising:
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1, and
 b) a second light chain (LC2)/heavy chain (HC2) pair comprising:
  (3) a second VL region (VL2) paired with a second VH region (VH2) to form a second antigen-binding site; and
  (4) a second constant heavy chain region 1 (CH1-2) operatively linked to VH2 and a second constant light chain region (CL2) operatively linked to VL2, wherein the C terminus of CH1-1 is operatively linked to the N terminus of VH2, and wherein one or more cysteine residues are engineered into the one or both of VH1NL1 and VH2NL2 pairs to form one or more disulfide bonds, wherein one or both of the VL1 and VH1 pair and the VL2 and VH2 pair comprise opposite charged mutations that facilitate pairing, wherein one or both of the CL1 and CH1-1 pair and the CL2 and CH1-2 pair comprise mutations that facilitate pairing, and wherein when both of CL1 and CH1-1 pair and of CL2 and CH1-2 pair comprise mutations to facilitate pairing, the mutations in CH1-1 and CL1 are different than the mutations in CH1-2 and CL2.

In some embodiments, CH1-1 comprises a T192E mutation and CL1 comprises N137K and S114A mutations.

In some embodiments, CH1-1 comprises L143Q and S188V mutations and CL1 comprises V133T and S176V mutations.

In some embodiments, CH1-1 comprises T192E, L143Q and S188V mutations and CL1 comprises N137K, S114A, V133T and S176V mutations.

In some embodiments, CH1-2 comprises a T192E mutation and CL2 comprises N137K and S114A mutations.

In some embodiments, CH1-2 comprises L143Q and S188V mutations and CL2 comprises V133T and S176V mutations.

In some embodiments, CH1-2 comprises T192E, L143Q and S188V mutations and CL2 comprises N137K, S114A, V133T and S176V mutations.

In some embodiments, one of both of CH1-1 and CH1-2 comprises a L143E, a L143D, a L143K, a L143R, or a L143H mutation, one or both of CL1 and CL2 comprises a S176E, a S176D, a S176K, a S176R, or a S176H mutation, and wherein the mutation in one of both of CH1-1 or CH1-2 is an opposite charge from the mutation in one or both of CL1 and CL2.

In some embodiments, one of both of CH1-1 and CH1-2 comprises a L124E, a L124D, a L124K, a L124R, or a L124H mutation, one or both of CL1 and CL2 comprises a V133E, a V133D, a V133K, a V133R, or a V133H mutation, and wherein the mutation in one of both of CH1-1 or CH1-2 is an opposite charge from the mutation in one or both of CL1 and CL2.

In some embodiments, one or both of VH1 and VH2 comprises a 39E, a 39D, a 39K, a 39R, or a 39H mutation, one or both of VL1 and VL2 comprises a 38E, a 38D, a 38K, a 38R, or a 38H mutation, and wherein the mutation in one or both of VH1 and VH2 is an opposite charge from the mutation in one or both of VL1 and VL2.

In some embodiments, one or both of VH1 and VH2 comprises a Q39E, a Q39D, a Q39K, a Q39R, or a Q39H mutation, one or both of VL1 and VL2 comprises a Q38E, a Q38D, a Q38K, a Q38R, or a Q38H mutation, and wherein the mutation in one or both of VH1 and VH2 is an opposite charge from the mutation in one or both of VL1 and VL2.

In some embodiments, the present disclosure provides a multispecific antigen-binding protein comprising:
 a) a first light chain (LC1)/heavy chain (HC1) pair comprising:
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1, and b) a second light chain (LC2)/heavy chain (HC2) pair comprising:
  (3) a second VL region (VL2) paired with a second VH region (VH2) to form a second antigen-binding site; and
  (4) a second constant heavy chain region 1 (CH1-2) operatively linked to VH2 and a second constant light chain region (CL2) operatively linked to VL2,
wherein the C terminus of CH1-1 is operatively linked to the N terminus of VH2, and
wherein one or more cysteine residues are engineered into the one or both of VH1NL1 and VH2NL2 pairs to form one or more disulfide bonds,
wherein one or both of the VL1 and VH1 pair and the VL2 and VH2 pair comprise opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region,
wherein one or both of the CL1 and CH1-1 pair and the CL2 and CH1-2 pair comprise mutations that facilitate pairing, and
wherein when both of CL1 and CH1-1 pair and of CL2 and CH1-2 pair comprise mutations to facilitate pairing, the mutations in CH1-1 and CL1 are different than the mutations in CH1-2 and CL2.

In some embodiments, the multispecific antibody further comprises one or more cysteine residues engineered into the one or both of VH1/VL1 and VH2/VL2 pairs to form one or more disulfide bonds.

In some embodiments, one or both of VH1 and VH2 comprises a 44C and a 105C mutation and one or both of VL1 and VL2 comprises a 100C and a 43C mutation.

In some embodiments, VH1 comprises a 44C mutation and VL1 comprises a 100C mutation.

In some embodiments, VH1 comprises a 105C mutation and VL1 comprises a 43C mutation.

In some embodiments, VH2 comprises a 44C mutation and VL2 comprises a 100C mutation.

In some embodiments, VH2 comprises a 105C mutation and VL2 comprises a 43C mutation.

In some embodiments, VH1 comprises 39E and 44C mutations and VL1 comprises 38K and 100C mutations.

In some embodiments, VH1 comprises 39E and 105C mutations and VL1 comprises 38K and 43C mutations.

In some embodiments, the multispecific antibody further comprises opposite charged mutations in the CH1-1/CL1 pair.

In some embodiments, the opposite charged mutations in the CH1-1/CL1 pair are selected from the group consisting of: K221E in the CH1-1 region and E123K in the CL1 region; K228D in the CH1-1 region and D122K in the CL1 region; L145E in the CH1-1 region and S176K in the CL1 region; and L128E in the CH1-1 region and V133K in the CL1 region.

In some embodiments, the multispecific antibody further comprises opposite charged mutations in the CH1-2/CL2 pair.

In some embodiments, the opposite charged mutations in the CH1-2/CL2 pair are selected from the group consisting of: K221E in the CH1-2 region and E123K in the CL2 region; K228D in the CH1-2 region and D122K in the CL2 region; L145E in the CH1-2 region and S176K in the CL2 region; and L128E in the CH1-2 region and V133K in the CL2 region.

In some embodiments, the CH1-1 domain is linked to a first CH2 domain and first CH3 domain, the CH1-2 domain is linked to a second CH2 domain and a second CH3 domain, and wherein the first CH2 and CH3 domains and the second CH2 and CH3 domains dimerize to form an Fc domain.

In some embodiments, the first CH3 domain comprises one or both of S354C and T366W mutations and the second CH3 domain comprises one or both of Y349C, T366S, L368A, and Y407V mutations to facilitate Fc domain heterodimerization.

In some embodiments, the C terminus of CH1-1 is operatively linked to the N terminus of VH2 via a peptide linker.

In some embodiments, the peptide linker comprises a (GGGGS)$_n$ (SEQ ID NO: 1) linker, wherein n is any integer from 1 to 5.

In some embodiments, the peptide linker comprises all or part of the sequence of a hinge region of one or more immunoglobulin(s) selected from IgA, IgG, and IgD.

In some embodiments, the peptide linker comprises the following sequence: EPKSCDKTHTSPPSPAPELLGGP-STPPTPSPSGG (SEQ ID NO: 2).

In another aspect, the present disclosure provides a multispecific antigen-binding protein or antibody comprising:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and
    (6) a second heterodimerization domain (HD2);
  wherein HD1 and HD2 heterodimerize,
  wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing, and
  wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) and a first constant light chain region (CL1); and
  b) a second light chain (LC2)/heavy chain (HC2) pair comprising (3) a second VL region (VL2) paired with a second VH region (VH2) to form a second antigen-binding site; and
(4) a second constant heavy chain region 1 (CH1-2) and a second constant light chain region (CL2);
wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing, and
wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and (6) a second heterodimerization domain (HD2);
wherein HD1 and HD2 heterodimerize,
wherein at least one or both of CH1-1 and CH1-2 comprise a K221E, a K221 D, a K221K, a K221R, or a K221H mutation and one or both of CL1 and CL2 comprise a E123E, a E123D, a E123K, a E123R, or a E123H mutation, wherein the mutation in one or both of CH1-1 and CH1-2 is an opposite charge from the mutation in one or both of CL1 and CL2 to facilitate pairing, and
wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) and a first constant light chain region (CL1); and
b) a second light chain (LC2)/heavy chain (HC2) pair comprising
(3) a second VL region (VL2) paired with a second VH region (VH2) to form a second antigen-binding site; and
(4) a second constant heavy chain region 1 (CH1-2) and a second constant light chain region (CL2);
wherein at least one or both of CH1-1 and CH1-2 comprise a K221E, a K221 D, a K221K, a K221R, or a K221H mutation and one or both of CL1 and CL2 comprise a E123E, a E123D, a E123K, a E123R, or a E123H mutation, wherein the mutation in one or both of CH1-1 and CH1-2 is an opposite charge from the mutation in one or both of CL1 and CL2 to facilitate pairing, and
wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing,
wherein at least one or both of CH1-1 and CH1-2 comprise a K221E, a K221 D, a K221K, a K221R, or a K221H mutation and one or both of CL1 and CL2 comprise a E123E, a E123D, a E123K, a E123R, or a E123H mutation, wherein the mutation in one or both of CH1-1 and CH1-2 is an opposite charge from the mutation in one or both of CL1 and CL2 to facilitate pairing, and
wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:
a) a first light chain (LC1)/heavy chain (HC1) pair comprising (1) a first VL region (VL1) paired with first VH region (VH1) to form a first antigen-binding site;
(2) a first constant heavy chain region 1 (CH1-1) and a first constant light chain region (CL1); and
b) a second light chain (LC2)/heavy chain (HC2) pair comprising (3) a second VL region (VL2) paired with a second VH region (VH2) to form a second antigen-binding site; and
(4) a second constant heavy chain region 1 (CH1-2) and a second constant light chain region (CL2);
wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing, wherein at least one or both of CH1-1 and CH1-2 comprise a K221E, a K221 D, a K221K, a K221R, or a K221H mutation and one or both of CL1 and CL2 comprise a E123E, a E123D, a E123K, a E123R, or a E123H mutation, wherein the mutation in one or both of CH1-1 and CH1-2 is an opposite charge from the mutation in one or both of CL1 and CL2 to facilitate pairing, and wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation.

In another aspect, the present disclosure provides a multispecific antigen-binding protein or antibody comprising:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);

wherein HD1 and HD2 heterodimerize, wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing, and wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation, and wherein at least one or both of VH1 and VH2 comprise a 44C mutation and one or both of VL1 and VL2 comprise a 100C mutation.

In another aspect, the present disclosure provides a multispecific antigen-binding protein or antibody comprising:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) and a first constant light chain region (CL1); and b) a second light chain (LC2)/heavy chain (HC2) pair comprising
(3) a second VL region (VL2) paired with a second VH region (VH2) to form a second antigen-binding site; and
(4) a second constant heavy chain region 1 (CH1-2) and a second constant light chain region (CL2);

wherein at least one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2 to facilitate pairing, and wherein at least one or both of CH1-1 and CH1-2 comprise one or more of a T192E, a L143Q, and a S188V mutation and at least one or both of CL1 and CL2 comprise one or more of a N137K, a S114A, a V133T, and a S176V mutation, and wherein at least one or both of VH1 and VH2 comprise a 44C mutation and one or both of VL1 and VL2 comprise a 100C mutation.

In another aspect, the present disclosure provides a multispecific antigen-binding protein or antibody comprising:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) and a first constant light chain region (CL1); and b) a second light chain (LC2)/heavy chain (HC2) pair comprising
(3) a second VL region (VL2) paired with a second VH region (VH2) to form a second antigen-binding site; and
(4) a second constant heavy chain region 1 (CH1-2) and a second constant light chain region (CL2);

wherein at least one or both of CH1-1 and CH1-2 comprises a L143E, a L143D, a L143K, a L143R, or a L143H mutation and at least one or both of CL1 and CL2 comprises a S176E, a S176D, a S176K, a S176R, or a S176H mutation, and wherein the mutation in one of both of CH1-1 or CH1-2 is an opposite charge from the mutation in one or both of CL1 and CL2.

In another aspect, the present disclosure provides a multispecific antigen-binding protein or antibody comprising:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) and a first constant light chain region (CL1); and b) a second light chain (LC2)/heavy chain (HC2) pair comprising
(3) a second VL region (VL2) paired with a second VH region (VH2) to form a second antigen-binding site; and
(4) a second constant heavy chain region 1 (CH1-2) and a second constant light chain region (CL2);

wherein at least one or both of CH1-1 and CH1-2 comprises a L124E, a L124D, a L124K, a L124R, or a L124H mutation and at least one or both of CL1 and CL2 comprises a V133E, a V133D, a V133K, a V133R, or a V133H mutation, and wherein the mutation in one of both of CH1-1 or CH1-2 is an opposite charge from the mutation in one or both of CL1 and CL2.

In some embodiments, CH1-1 further comprises a T192E mutation and CL1 comprises N137K and S114A mutations.

In some embodiments, CH1-2 comprises a T192E mutation and CL2 comprises N137K and S114A mutations.

In some embodiments, one or both of VH1 and VH2 comprises a Q39E, Q39D, Q39K, Q39R, or Q39H mutation, and one or both of VL1 and VL2 comprises a Q38E, Q38D, Q38K, Q38R, or Q38H mutation, wherein the mutation in one or both of VH1 and VH2 is an opposite charge from the mutation in one or both of VL1 and VL2.

In some embodiments, the multispecific antibody further comprises one or more cysteine residues engineered into the one or both of VH1NL1 and VH2NL2 pairs to form one or more disulfide bonds.

In some embodiments, one or both of VH1 and VH2 comprises 44C and 105C mutations, and one or both of VL1 and VL2 comprises 100C and 43C mutations.

In some embodiments, VH1 comprises a 44C mutation and VL1 comprises a 100C mutation.

In some embodiments, VH1 comprises a 105C mutation and VL1 comprises a 43C mutation.

In some embodiments, VH2 comprises a 44C mutation and VL2 comprises a 100C.

In some embodiments, VH2 comprises a 105C mutation and VL2 comprises a 43C mutation.

In some embodiments, VH1 comprises 39E and 44C mutations and VL1 comprises 38K and 100C mutations.

In some embodiments, VH1 comprises 39E and 105C mutations and VL1 comprises 38K and 43C mutations.

In some embodiments, the multispecific antibody further comprises opposite charged mutations in one or both of the CH1-1/CL1 pair and the CH1-2/CL2 pair.

In some embodiments, the opposite charged mutations in the one or both of the CH1-1/CL1 pair and the CH1-2/CL2 pair comprise K221E in one or both of the CH1-1 region and CH2-2 region and E123K in one or both of the CL1 region and CL2 region.

In some embodiments, the CH1-1 domain is operatively linked to a first Fc domain comprising a first CH2 and first CH3 domain, and the CH1-2 domain is operatively linked to a second Fc domain comprising a second CH2 and second CH3 domain, and wherein the first Fc domain and the second Fc domain dimerize.

In some embodiments, the first CH3 domain comprises one or both of S354C and T366W mutations, the second CH3 domain comprises one or more of Y349C, T366S, L368A, and Y407V mutations, and wherein the mutations facilitate Fc domain heterodimerization.

In another aspect, the present disclosure provides an antigen-binding protein comprising:
  an antigen-binding domain and a constant heavy chain CH1 region paired with a constant light chain CL region,
  wherein the antigen-binding domain selectively binds to a target antigen, and wherein the CH1 region and CL region comprise one or both of:
  a) a L143E, L143D, L143K, L143R, or L143H mutation in the CH1 region and a S176E, S176D, S176K, S176R, or S176H mutation in the CL region; and
  b) a L124E, L124D, L124K, L124R, or L124H mutation in the CH1 region and a V133E, V133D, V133K, V133R, or V133H mutation in the CL region,
  wherein the mutated residue in the CH1 region has an opposite charge from the mutated residue in the CL region.

In another aspect, the present disclosure provides a binding protein comprising a protein binding domain; and a CH1 region paired with a CL region,
  wherein the protein binding domain selectively binds to a target antigen, and wherein the CH1 region and CL region comprise one or both of:
  a) a L143E, L143D, L143K, L143R, or L143H mutation in the CH1 region and a S176E, S176D, S176K, S176R, or S176H mutation in the CL region; and
  b) a L124E, L124D, L124K, L124R, or L124H mutation in the CH1 region and a V133E, V133D, V133K, V133R, or V133H mutation in the CL region,
  wherein the mutation in the CH1 region is an opposite charge from the mutation in the CL region.

In another aspect, the present disclosure provides an antigen-binding protein comprising a constant heavy chain CH1 region paired with a constant light chain CL region,
  wherein the antigen-binding domain selectively binds to a target antigen, and wherein the CH1 region and CL region comprise one or both of:
  a) a L143E, L143D, L143K, L143R, or L143H mutation in the CH1 region and a S176E, S176D, S176K, S176R, or S176H mutation in the CL region; and
  b) a K221E and a K228D mutation in the CH1 region and a D122K and a E123K mutation in the CL region,
  wherein the mutated residue in the CH1 region has an opposite charge from the mutated residue in the CL region.

In some embodiments, the binding protein further comprises a K221E mutation in the CH1 region and a E123K mutation in the CL region.

In some embodiments, the present disclosure provides a multispecific antigen-binding protein comprising a first Fab, said first Fab comprising CH1-1, VH1, CL1 and VL1 domains, and a second Fab, said second Fab comprising CH1-2, VH2, CL2 and VL2 domains, wherein first Fab and second Fab are selected from one of the following alternatives
  i. A first Fab comprises 143R mutation in CH1-1, 39K mutation in VH1, 176E mutation in CL1, 38E mutation in VL1 and a second Fab comprises 143E mutation in CH1-2, 39E mutation in VH2, 176R mutation in CL2 and 38K mutation in VL2;
  ii. A first Fab comprises 143K mutation in CH1-1, 39K mutation in VH1, 176E mutation in CL1, 38E mutation in VL1 and a second Fab comprises 143E mutation in CH1-2, 39E mutation in VH2, 176K mutation in CL2 and 38K mutation in VL2;
  iii. A first Fab comprises 143H mutation in CH1-1, 39K mutation in VH1, 176E mutation in CL1, 38E mutation in VL1 and a second Fab comprises 143E mutation in CH1-2, 39E mutation in VH2, 176H mutation in CL2 and 38K mutation in VL2;
  iv. A first Fab comprises 143R mutation in CH1-1, 39K mutation in VH1, 176D mutation in CL1, 38E mutation in VL1 and a second Fab comprises 143D mutation in CH1-2, 39E mutation in VH2, 176R mutation in CL2 and 38K mutation in VL2;
  v. A first Fab comprises 143K mutation in CH1-1, 39K mutation in VH1, 176D mutation in CL1, 38E mutation in VL1 and a second Fab comprises 143D mutation in CH1-2, 39E mutation in VH2, 176K mutation in CL2 and 38K mutation in VL2;
  vi. A first Fab comprises 143H mutation in CH1-1, 39K mutation in VH1, 176D mutation in CL1, 38E mutation in VL1 and a second Fab comprises 143D mutation in CH1-2, 39E mutation in VH2, 176H mutation in CL2 and 38K mutation in VL2.

In some embodiments, the CH1 region is operably linked to a heterodimerization domain.

In some embodiments, the heterodimerization domain comprises a first Fc domain.

In some embodiments, the first Fc domain heterodimerizes with a second Fc domain, and wherein the first Fc domain comprises a first CH3 region and the second Fc domain comprises a second CH3 region.

In some embodiments, the first CH3 region comprises one or both of S354C and T366W mutations, and the second CH3 region comprises one or more of Y349C, T366S, L368A, and Y407V mutations, wherein the mutations facilitate Fc domain heterodimerization.

In some embodiments, the antigen-binding protein further comprises at least one VHNL pair comprising opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region.

In some embodiments, a multispecific antigen-binding protein or antigen-binding protein comprises three HCDRs for each VH region and three LCDRs for each VL region, and further comprises binding specificity to one or more target antigens or one or more target epitopes. In some embodiments, the HCDRs, LCDRs and/or antigen are disclosed herein. In some embodiments, the HCDRs, LCDRs and/or antigen are known in the art. In some embodiments, the HCDRs, LCDRs and/or antigen have been newly identified or discovered.

In some embodiments, the present disclosure provides an antigen-binding protein comprising:
- an antigen-binding domain; and a constant heavy chain CH1 region paired with a constant light chain CL region,
- wherein the antigen-binding domain selectively binds to a target antigen, and
- wherein the CH1 region and CL region comprise one or both of:
  a) a L143E, a L143D, a L143K, a L143R, or a L143H mutation in the CH1 region and a S176E, a S176D, a S176K, a S176R, or a S176H mutation in the CL region; and
  b) a L124E, a L124D, a L124K, a L124R, or a L124H mutation in the CH1 region and a V133E, a V133D, a V133K, a V133R, or a V133H mutation in the CL region,
- wherein the mutated residue in the CH1 region has an opposite charge from the mutated residue in the CL region.

In some embodiments, the antigen-binding protein further comprises CH1/CL mutations to facilitate pairing selected from the group consisting of one or more of:
(1) a T192E (CH1) mutation and N137K and S114A (CL) mutations,
(2) L143Q and S188V (CH1) mutations, and V133T and S176V (CL) mutations,
(3) T192E, L143Q and S188V (CH1) mutations and N137K, S114A, V133T and S176V (CL) mutations,
(4) a K221E (CH1) mutation and a E123K (CL) mutation,
(5) a K228D (CH1) mutation and a D122K (CL) mutation, and
(6) K221E and K228D (CH1) mutations and D122K and E123K (CL) mutations,
wherein when two CH1/CL pairs comprise mutations to facilitate pairing for two different VHNL pairs, the two CH1/CL pairs do not comprise the same mutations.

In some embodiments, the CH1 region is operably linked to a Fc domain.

In some embodiments, an isolated nucleic acid molecule comprising a nucleotide sequence encoding the multispecific antibody or antigen-binding protein, is provided. In some embodiments, a kit comprising one or more isolated nucleic acid molecules comprising one or more nucleotide sequences encoding the multispecific antigen-binding protein or antigen-binding protein, is provided.

In some embodiments, an expression vector comprising the nucleic acid molecule is provided. In some embodiments, a kit comprising one or more expression vectors comprising one or more of the nucleic acid molecules is provided.

In some embodiments, an isolated host cell comprising the one or more nucleic acid molecules or the one or more expression vectors is provided. In some embodiments, an isolated host cell comprising the kit of nucleic acid molecules or the kit of expression vectors is provided.

In some embodiments, the host cell is a mammalian cell or an insect cell.

In some embodiments, a pharmaceutical composition comprising a pharmaceutically acceptable carrier and a therapeutically effective amount of the multispecific antibody or antigen-binding protein is provided.

In some embodiments, a method of treating a disorder in which antigen activity is detrimental, the method comprising administering to a subject in need thereof an effective amount of a multispecific antibody or antigen-binding protein is provided.

In some embodiments, a polynucleotide encoding a multispecific antibody or antigen-binding protein is provided.

In some embodiments, a host cell expressing a multispecific antibody or antigen-binding protein is provided.

In some embodiments, a method of producing a multispecific antibody or antigen-binding protein comprising culturing the host cell under conditions such that a multispecific antibody or antigen-binding protein is expressed is provided. In some embodiments, a multispecific antibody or antigen-binding protein for use as a medicament is provided.

The summary of the disclosure described above is non-limiting and other features and advantages of the disclosed antigen-binding proteins and methods will be apparent from the following brief description of the drawings, detailed description of the disclosure, and claims.

BRIEF DESCRIPTION OF THE DRAWINGS

FIG. 1A-FIG. 1C schematically depict cross-over dual variable (CODV) antigen-binding protein formats with several different mutations to enhance heterodimerization. FIG. 1A depicts CH1/kappa mutations "O" on CODV-Fab (CH1: L143Q, S188V; Ck: V133T, S176V) and "Δ" on Fab2 (CH1: T192E; Ck: N137K, S114A). FIG. 1B depicts mutations on CODV-Fab (VH39ENL38K+O) and Fab2 (VH39K/VL38E+Δ). FIG. 1C depicts mutations on CODV-Fab ([VH39ENL38K+0]+[VH44CysNL1000ys] or [VH105CysNL43Cys]) and Fab2 ([VH39K/VL38E+Δ]+[VH44CysNL100Cys] or [VH105CysNL43Cys]).

FIG. 2A depicts results for the WT CODV antibody. FIG. 2B depicts results for a CODV antibody with only the CH1/Ck mutations. FIG. 2C depicts results for a CH1/Ck and charge mutation (CM) combination. FIG. 2D depicts results for the disulfide-stabilized (ds) only CODV antibody. FIG. 2E depicts results for a CH1/Ck and ds mutation combination. FIG. 2F depicts results for a CM and ds mutation combination. FIG. 2G depicts results for the combination of all three mutation sets, CH1/Ck, CM, and ds stabilized, in a CODV antibody.

FIG. 3A shows open configuration with CH1/kappa mutations "Δ" on Fab1 (CH1: T192E; Ck: N137K, S114A) and "O" on Fab2 (CH1: L143Q, S188V; Ck: V133T, S176V. FIG. 3B shows open configuration with mutations on Fab1 (VH39KVL38E+Δ) and Fab2 (VH39ENL38K+O). FIG. 3C shows closed configuration with CH1/kappa mutations A on Fab1 (CH1: T192E; Ck: N137K, S114A) and O on Fab2 (CH1: L143Q, S188V; Ck: V133T, S176V). FIG. 3D shows closed configuration with mutations on Fab1 (VH39KVL38E+Δ) and Fab2 (VH39ENL38K+O).

FIG. 5A-FIG. 5D depict the results of HIC analysis, yield, and binding affinity for an anti-CD40×anti-PD-L1 tandem Fab antibody in the open and closed configurations. FIG. 5A shows a closed configuration with CH1/Ck mutations only. FIG. 5B shows a closed configuration with Fab domain swap with CH1/Ck mutations only. FIG. 5C shows a closed configuration with CH1/Ck and CM mutations. FIG. 5D shows an open configuration with CH1/Ck and CM mutations.

FIG. 6A-FIG. 6C depict the results of HIC analysis, yield, and binding affinity for an anti-PD-1×anti-OX40 tandem Fab antibody in the open and closed configurations. FIG. 6A shows a closed configuration with CH1/Ck mutations only. FIG. 6B shows an open configuration with CH1/Ck mutations only. FIG. 6C shows an open configuration with CH1/Ck and CM mutations.

FIG. 8A shows CH1/kappa mutations "O" on Fab1 (CH1: L143Q, S188V; Ck: V133T, S176V) and "Δ" on Fab2 (CH1: T192E; Ck: N137K, S114A). FIG. 8B shows mutations on Fab1 (VH39ENL38K+O) and Fab2 (VH39K/VL38E+Δ).

FIG. 10A-FIG. 10L depicts SEC and HIC profiles for various anti-PD-1×anti-OX40 antibodies with several different combinations of mutations. The specific mutations are recited in Table 9 below.

FIG. 11A depicts mispairing data for anti-PD-1×anti-GITR antibodies. FIG. 11B depicts mispairing data for anti-TNF×anti-GITR antibodies. FIG. 11C depicts mispairing data for anti-TNF×anti-OX40 antibodies. FIG. 11D depicts mispairing data for anti-CD40×anti-PD-L1 antibodies. FIG. 11E depicts mispairing data for anti-CD3×anti-CD123 antibodies. The specific mutations and biophysical characterization data are recited in Table 11 below.

DETAILED DESCRIPTION OF THE DISCLOSURE

I. Definitions

Figure 2A:
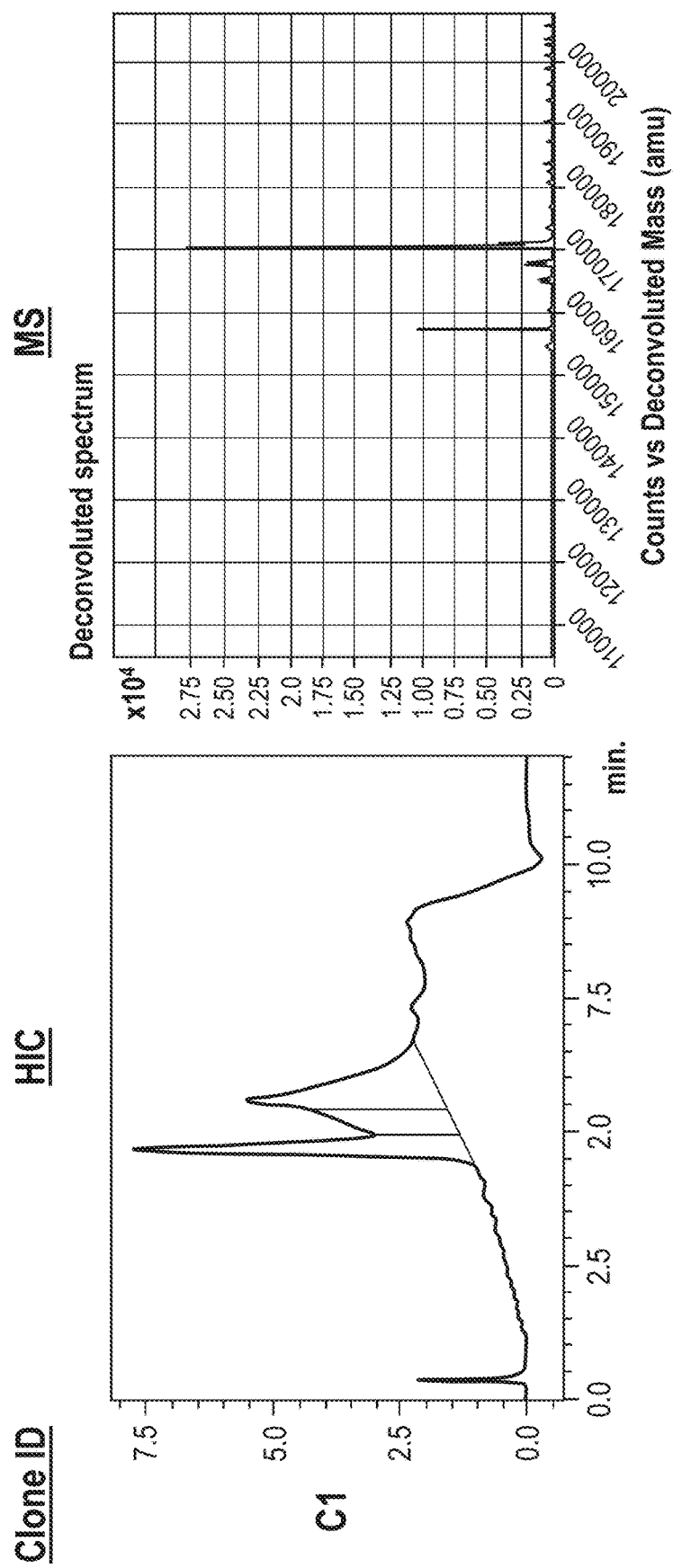
FIG. 2A-FIG. 2G graphically depict the results for Table 5.
Figure 2B:
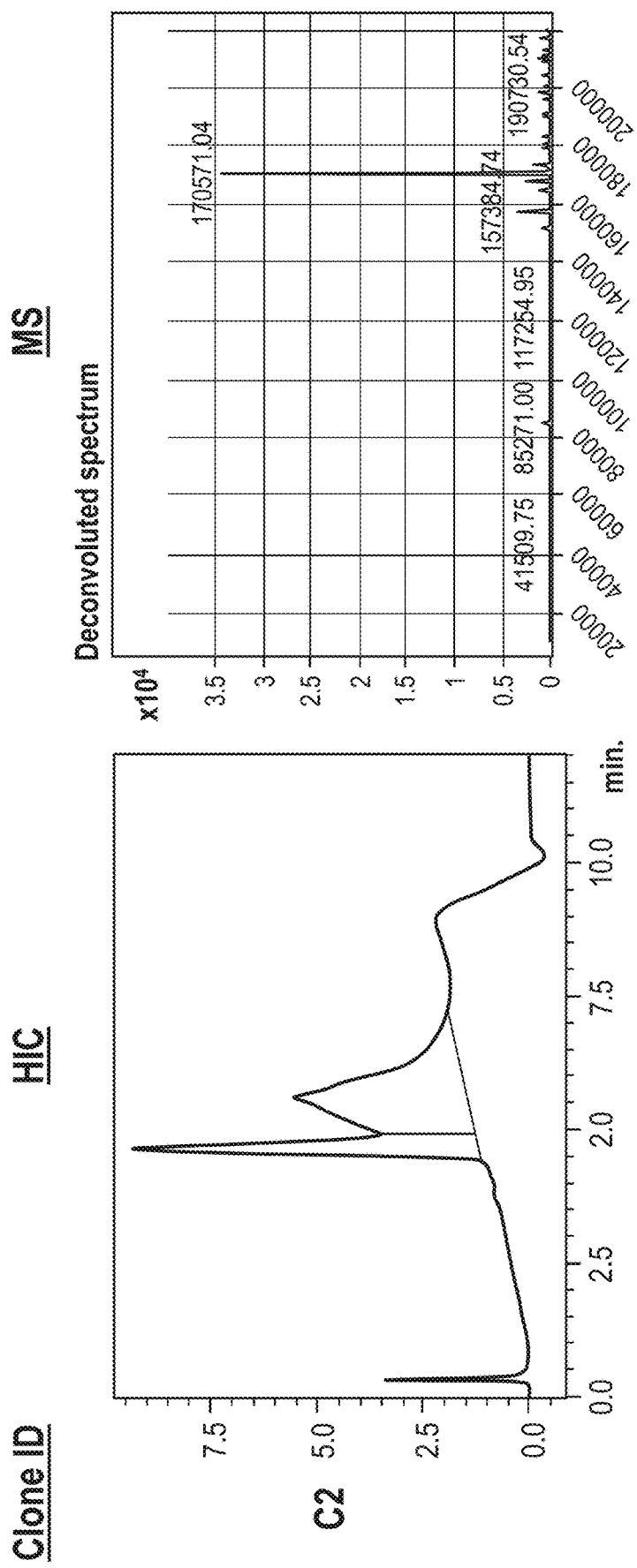
Figure 2C:
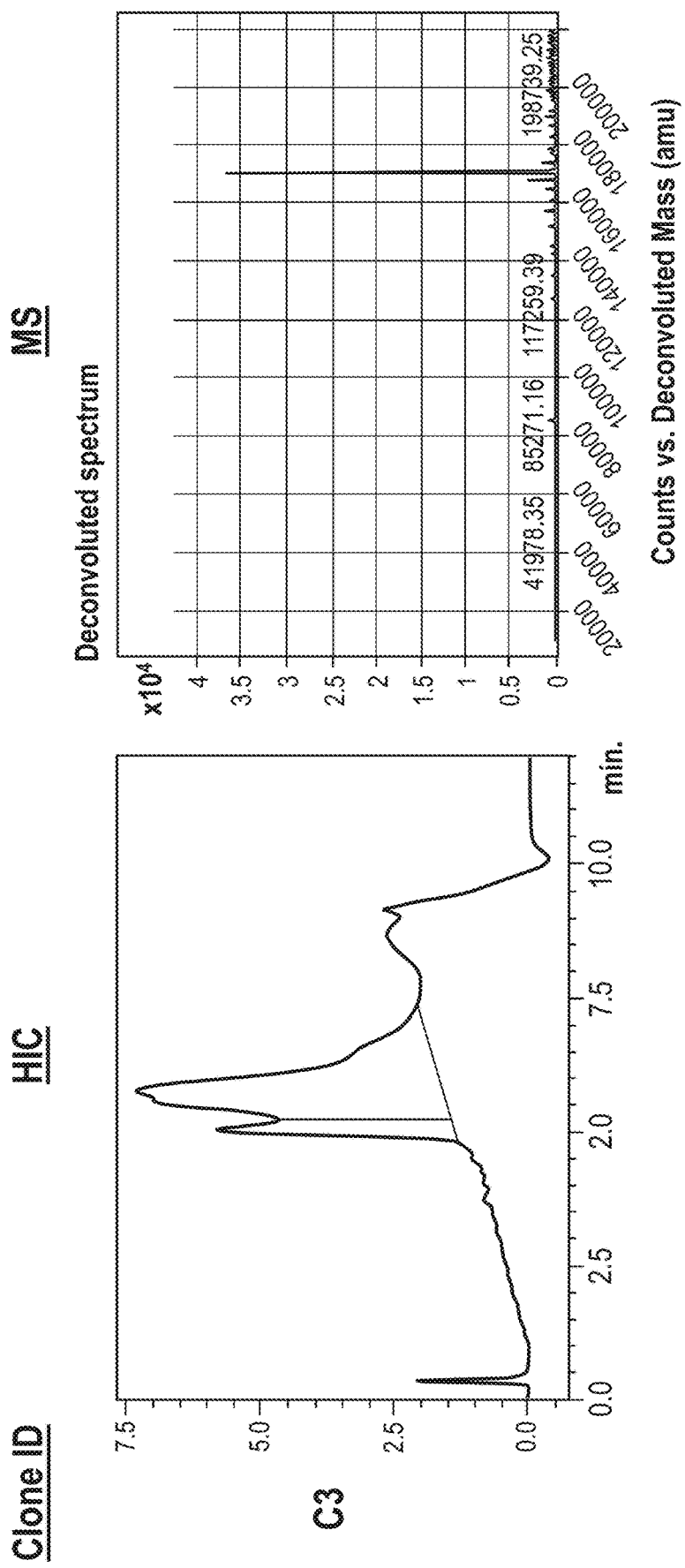
Figure 2D:
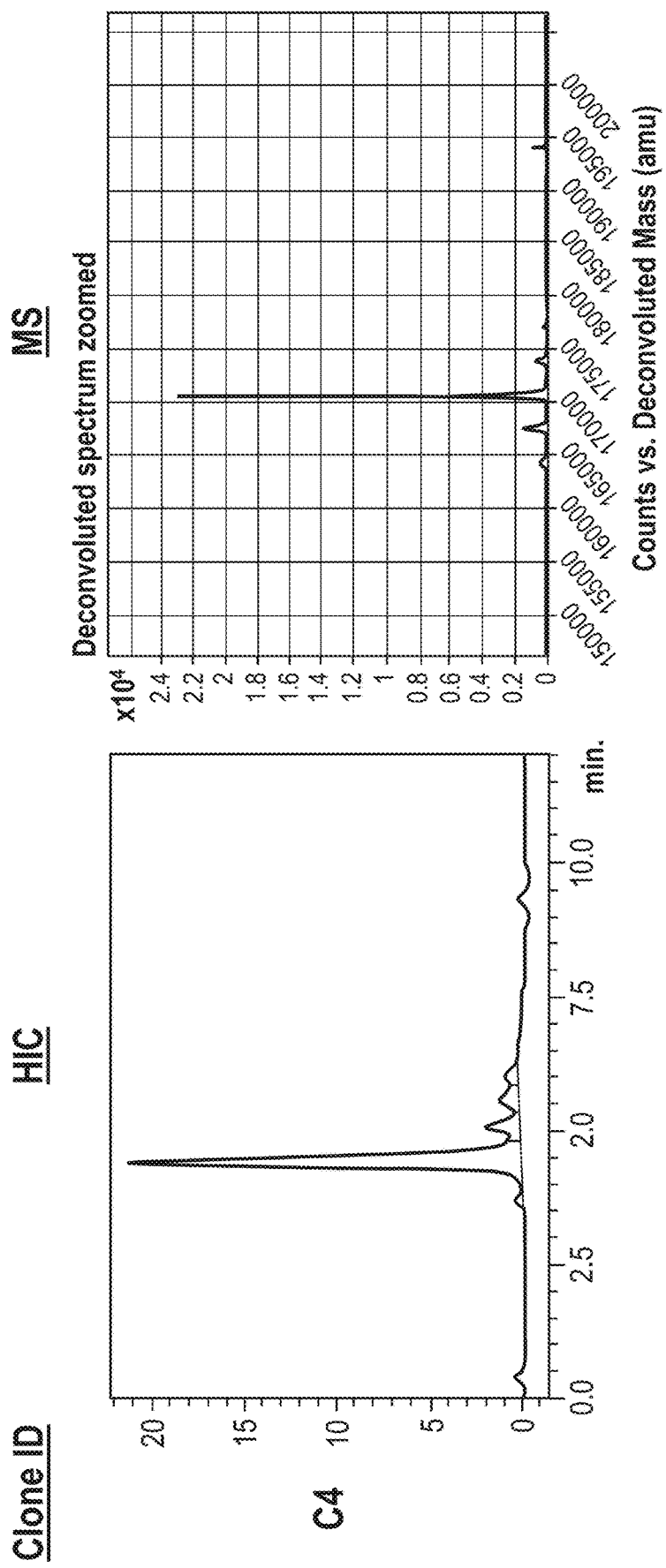
Figure 2E:
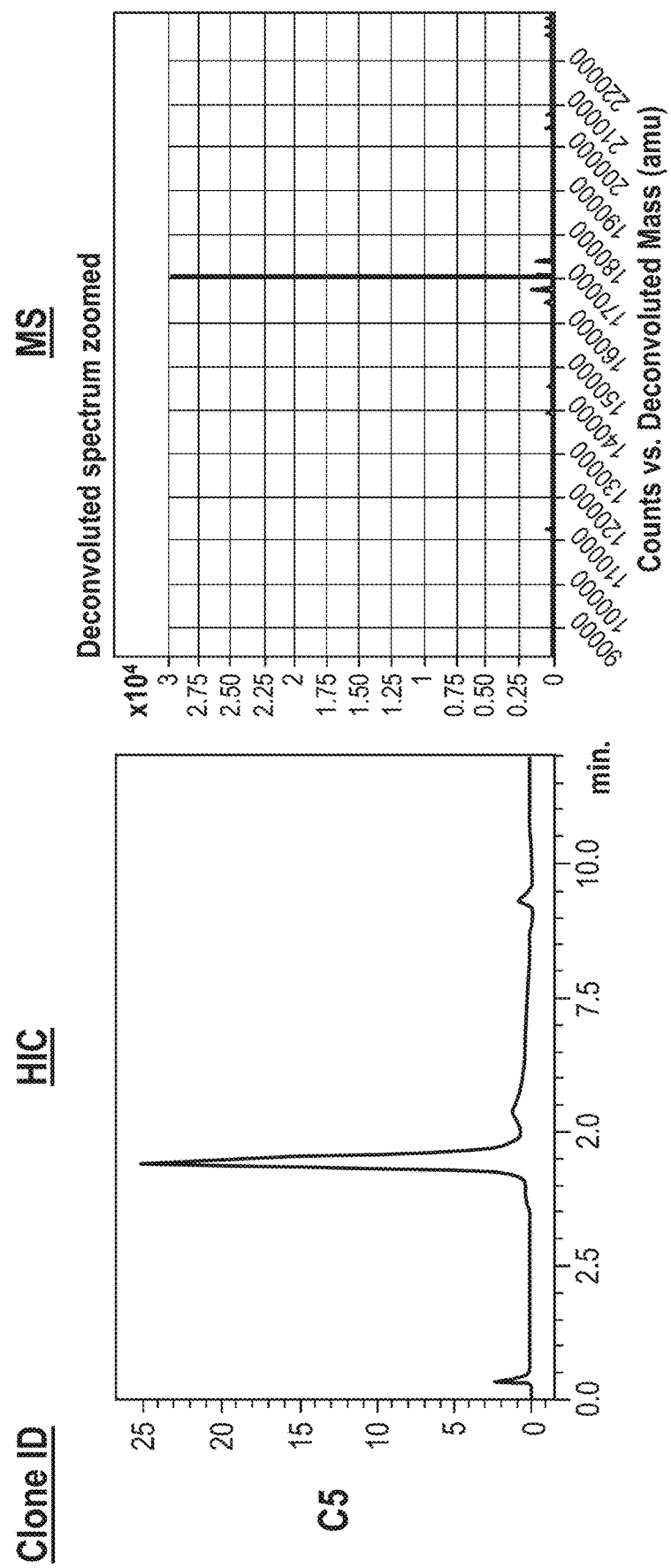
Figure 2F:
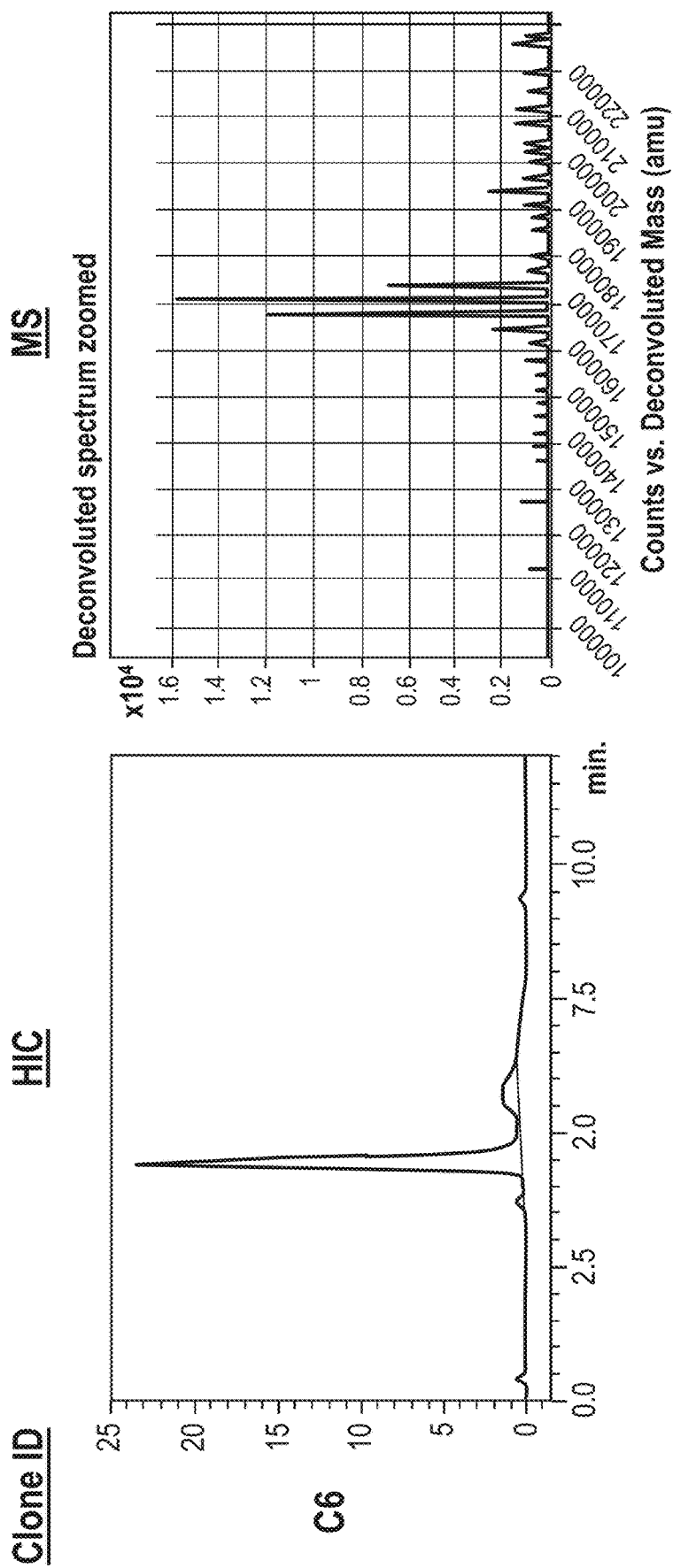
Figure 2G:
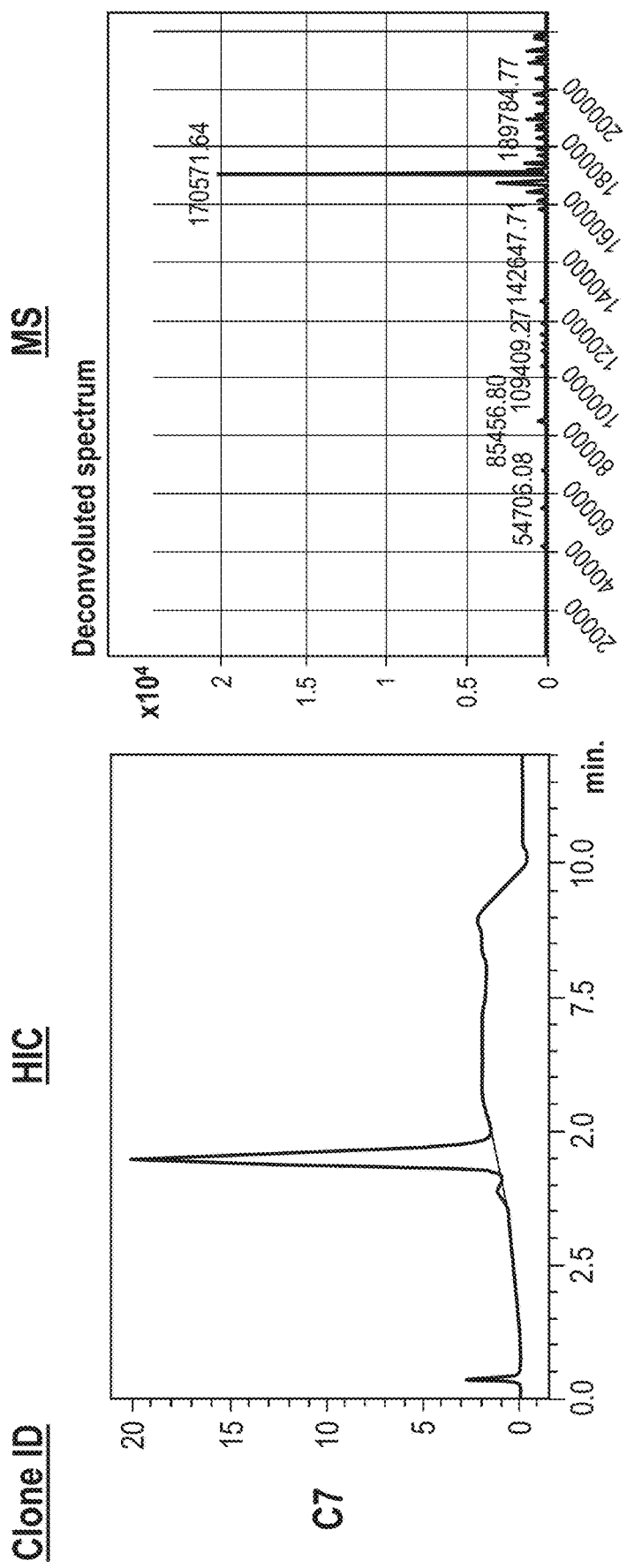

So that the disclosure may be more readily understood, selected terms are defined below.

Sequence position numbers used herein refer to Kabat numbering (Kabat, E. A. et al., Sequences of proteins of immunological interest. 5th Edition—US Department of Health and Human Services, NIH publication no 91-3242, pp 662,680,689, 1991).

As used herein, the twenty conventional amino acids and their abbreviations follow conventional usage. Stereoisomers (e.g., D-amino acids) of the twenty conventional amino acids; unnatural amino acids such as a-disubstituted amino acids, N-alkyl amino acids, lactic acid, and other unconventional amino acids may also be suitable components for the polypeptide chains of the binding proteins described herein. Examples of unconventional amino acids include: 4-hydroxyproline, y-carboxyglutamate, c-N,N,N-trimethyllysine, c-N-acetyllysine, u-phosphoserine, N-acetylserine, N-formylmethionine, 3-methylhistidine, 5-hydroxylysine, u-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. Naturally occurring residues may be divided into classes based on common side chain properties (see Table 1).

TABLE 1

| Amino acid residues by classes. | | |
|---|---|---|
| Charge properties/ Hydrophobicity | Side group | Amino Acid |
| nonpolar hydrophobic | aliphatic | Ala (A), Ile (I), Leu (L), Val (V) |
| | aliphatic, S-containing | Met (M) |
| | aromatic | Phe (F), Trp (W) |
| | imino | Pro (P) |
| polar uncharged | aliphatic | Gly (G) |
| | amide | Asn (N), Gln (Q) |
| | aromatic | Tyr (Y) |
| | hydroxyl | Ser (S), Thr (T) |
| | sulfhydryl | Cys (C) |
| positively charged | basic | Arg (R), His (H), Lys (K) |
| negatively charged | acidic | Asp (D), Glu (E) |

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid residues. Non-conservative substitutions may involve the exchange of a member of one of these classes for a member from another class.

As used herein, the term "mutation" or "mutated" refers to an alteration of the amino acid sequence by deletion, insertion and/or substitution of one or more amino acids. In particular, it refers to a substitution. A mutation is introduced with respect to a given sequence, e.g., the amino acid sequence of a VL1 and/or VH1 pair that specifically recognizes a first antigen.

As used herein, a "T192E (CH1) mutation" refers to the substitution of a threonine (T) residue for a glutamic acid (E) residue, in the immunoglobulin CH1 heavy chain constant domain of an antigen-binding protein, at the Kabat position 192.

As used herein, a "mutation set" refers to a group of different mutations present in a sequence.

As used herein, the term "variant" refers to an amino acid sequence that is at least 80%, 85%, 90%, 95%, 96%, 97%, 98% or 99% identical to the amino acid sequence it is derived from. The determination of percent identity between two sequences is accomplished using the mathematical algorithm of Karlin and Altschul, Proc.

Natl. Acad. Sci. USA 90, 5873-5877, 1993. Such an algorithm is incorporated into the BLASTN and BLASTP programs of Altschul et al. (1990) J. Mol. Biol. 215, 403-410. To obtain gapped alignments for comparative purposes, Gapped BLAST is utilized as described in Altschul et al. (1997) Nucleic Acids Res. 25, 3389-3402. When utilizing BLAST and Gapped BLAST programs, the default parameters of the respective programs are used. Alternatively, a variant can also be defined as having up to 20, 15, 10, 5, 4, 3, 2, or 1 amino acid substitutions, in particular conservative amino acid substitutions. Conservative substitutions are well known in the art (see for example Creighton (1984) Proteins. W.H. Freeman and Company). An overview of physical and chemical properties of amino acids is given in Table 1 above. In a particular embodiment, conservative substitutions are substitutions made with amino acids having at least one property according to Table 1 in common (i.e., of column 1 and/or 2). The term "variant" also includes fragments. A fragment has an N-terminal and/or C-terminal deletion of up to 20, 15, 10, 5, 4, 3, 2, or 1 amino acid(s) in total. In addition or alternatively, the variant may be modified, for example by N-terminal and/or C-terminal amino acid additions of up to 50, 40, 30, 20, 10, 5, 4, 3, 2, or 1 amino acid(s) in total.

As used herein, the term "antigen" or "target antigen" or "antigen target" refers to a molecule or a portion of a molecule (e.g., epitope) that is capable of being specifically bound by a binding protein described herein, and additionally is capable of being used in an animal to produce antibodies capable of specific binding to an epitope of that antigen. A target antigen may have one or more epitopes. With respect to each target antigen recognized by a binding protein, the binding protein is capable of competing with an intact antibody that recognizes the target antigen.

As used herein, the term "epitope" refers to any determinant, e.g., a polypeptide determinant, capable of specifically binding to an immunoglobulin or T-cell receptor. In certain embodiments, epitope determinants include chemically active surface groupings of molecules such as amino acids, sugar side chains, phosphoryl groups, or sulfonyl groups, and, in certain embodiments, may have specific three-dimensional structural characteristics and/or specific charge characteristics. An epitope is a region of an antigen that is bound by an antibody or by an antigen-binding fragment of an antibody or by a binding protein. In certain embodiments, a binding protein is said to specifically bind an antigen when it preferentially recognizes its target antigen in a complex mixture of proteins and/or macromolecules. In some embodiments, a binding protein is said to specifically bind an antigen when the equilibrium dissociation constant is $<10^{-8}$ M, when the equilibrium dissociation constant is $<1^{-9}$ M, or when the dissociation constant is $<10^{-10}$ M.

As used herein, the term "antigen-binding protein" or "binding protein" or "binding polypeptide" refers to a polypeptide (e.g., an antibody or fragment thereof) that contains at least one binding site which is responsible for selectively binding to a target antigen of interest (e.g., a human antigen). Exemplary binding sites include, but are not limited to, an antibody variable domain, a ligand binding site of a receptor, or a receptor binding site of a ligand. In certain aspects, the binding polypeptides comprise multiple (e.g., two, three, four, or more) binding sites. In certain aspects, the binding protein is not a therapeutic enzyme.

As used herein a "heterodimerization domain" or "HD" refers to a subunit of a bispecific, trispecific or a multispecific binding protein that facilitates, directs or forces the correct assembly of light chains and their cognate heavy chains to result in the desired protein while preventing mispairing of the respective light or heavy chains.

As used herein, a "multispecific" binding protein is a binding protein that binds two or more antigens, and/or two or more different epitopes. A multispecific binding protein that binds two antigens, and/or two different epitopes, is also referred to herein as a "bispecific" binding protein. A multispecific binding protein that binds three antigens, and/ or three different epitopes, is also referred to herein as a "trispecific" binding protein.

As used herein, the term "heterodimerizing Fc" or "functional fragment of a heterodimerizing Fc" refers to a mutant form of the constant domain, e.g., the CH2-CH3 or CH2-CH3-CH4, that is mutated with regard to a naturally occurring Fc part in that it no longer forms homodimers but forms a heterodimer with a correspondingly mutated Fc part. Thus, the term refers to one part of the two chains that form a heterodimer. Several of such pairs are known in the art and comprise, e.g., knob-in-hole (KIH) variants or EV-RWT variants.

Ridgeway and coworkers generated a CH3 interface favoring heterodimeric assembly by replacing small side chains on one CH3 interface with larger side chains to create a knob and replacing large side chains on the other CH3 domain with smaller side chains to generate a hole. Testing such variants demonstrated a preferential heterodimerization. The original knobs-into-holes mutations were further extended to identify further suitable combinations by phage display which were used to generate bispecific IgG antibodies testing additional substitutions allowing for disulfide bond formation. The knobs-in-hole variants are described further in U.S. Pat. Nos. 5,732,168 and 8,216,805, which are herein incorporated by reference. Accordingly, in an embodiment, the CH3 domain of one Fc domain or heterodimerization domain contains the mutations Y349C, T366S, L368A, and Y407V, and the CH3 domain of another FC domain or heterodimerization domain contains the mutations S354C and T366W (amino acid position being indicated by reference to an IgG1 sequence).

As used herein, the term "homodimerization domain" refers to a domain mediating the homodimerization of to like domains, e.g., two heavy chains. Heavy chain pairing is mediated by the last domain of the constant region, i.e., CH3 in IgG molecules, which forms high-affinity homodimer complexes ($K_D$ of approximately 10 pM). Further interactions reside in the hinge region responsible for covalent linkage of two heavy chains, which form after heavy chain assembly. Interaction in a CH3 homodimer involves approximately 16 residues at the CH3-CH3 interface as shown for human γ1 CH3 with patch formed by 6 residues (T366, L368, F405, Y407 and K409) at the center of the interface strongly contributing to stability. Homodimerization domains include, but are not limited to, Fc regions and effector modified variants thereof and fragments of either, CH2 domains or fragments thereof, CH3 domains or fragments thereof, CH4 domains or fragments or the like.

Naturally-occurring antibodies typically comprise a tetramer. Each such tetramer is typically composed of two identical pairs of polypeptide chains, each pair having one full-length "light" chain (typically having a molecular weight of about 25 kDa) and one full-length "heavy" chain (typically having a molecular weight of about 50-70 kDa). The terms "heavy chain" and "light chain," as used herein, refer to any immunoglobulin polypeptide having sufficient variable domain sequence to confer specificity for a target antigen. The amino-terminal portion of each light and heavy chain typically includes a variable domain of about 100 to 110 or more amino acids that typically is responsible for antigen recognition. The carboxy-terminal portion of each chain typically defines a constant domain responsible for effector function. Thus, in a naturally occurring antibody, a full-length heavy chain IgG immunoglobulin polypeptide includes a variable domain (VH) and three constant domains (CH1, CH2, and CH3), wherein the VH domain is at the amino-terminus of the polypeptide and the CH3 domain is at the carboxyl-terminus, and a full-length light chain immunoglobulin polypeptide includes a variable domain (VL) and a constant domain (CL), wherein the VL domain is at the amino-terminus of the polypeptide and the CL domain is at the carboxyl-terminus.

In some embodiments, the multispecific antigen-binding proteins of the disclosure comprise one or more VH domains from any one of the VH domain sequences recited in Tables 2, 3, and 4. In some embodiments, the multispecific antigen-binding proteins of the disclosure comprise one or more VL domains from any one of the VL domain sequences recited in Tables 2, 3, and 4. In some embodiments, the multispecific antigen-binding proteins of the disclosure comprise one or more VH domains from any one of the VH domain sequences recited in Tables 2, 3, and 4, paired with one or more VL domains from any one of the VL domain sequences recited in Tables 2, 3, and 4.

Human light chains are typically classified as kappa and lambda light chains, and human heavy chains are typically classified as mu, delta, gamma, alpha, or epsilon, and define the antibody's isotype as IgM, IgD, IgG, IgA, and IgE, respectively. IgG has several subclasses, including, but not limited to, IgG1, IgG2, IgG3, and IgG4. IgM has subclasses including, but not limited to, IgM1 and IgM2. IgA is similarly subdivided into subclasses including, but not limited to, IgA1 and IgA2. Within full-length light and heavy chains, the variable and constant domains typically are joined by a "J" region of about 12 or more amino acids, with the heavy chain also including a "D" region of about 10 more amino acids. See, e.g., Fundamental Immunology (Paul, W., ed., Raven Press, 2nd ed., 1989), which is incorporated by reference in its entirety for all purposes. The variable regions of each light/heavy chain pair typically form an antigen-binding site. The variable domains of naturally occurring antibodies typically exhibit the same general structure of relatively conserved framework regions (FR) joined by three hypervariable regions, also called complementarity determining regions or CDRs. The CDRs from the two chains of each pair typically are aligned by the framework regions, which may enable binding to a specific epitope. From the amino-terminus to the carboxyl-terminus, both light and heavy chain variable domains typically comprise the domains FR1, CDR1, FR2, CDR2, FR3, CDR3, and FR4.

As used herein, the term "CDR sets" refers to a group of three CDRs that occur in a single variable region capable of binding the antigen. The exact boundaries of these CDRs have been defined differently according to different systems. The system described by Kabat (Kabat et al., SEQUENCES OF PROTEINS OF IMMUNOLOGICAL INTEREST (National Institutes of Health, Bethesda, MD (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk, 1987, J. Affol. Biol. 196: 901-17; Chothia et al., 1989, Nature 342: 877-83) found that certain sub-portions within Kabat CDRs adopt nearly identical peptide backbone conformations, despite having great diversity at the level of amino acid sequence. These sub-portions were designated as L1, L2, and L3 or H1, H2, and H3 where the "L" and the "H" designate the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan, 1995, FASEB J. 9: 133-39; MacCallum, 1996, J. Mol. Biol. 262(5): 732-45; and Lefranc, 2003, Dev. Comp. Immunol. 27: 55-77. Still other CDR boundary definitions may not strictly follow one of the systems described herein, but will nonetheless overlap with the Kabat CDRs, although they may be shortened or lengthened in light of prediction or experimental findings that particular residues or groups of residues or even entire CDRs do not significantly impact antigen-binding. The methods used herein may utilize CDRs defined according to any of these systems, although certain embodiments use Kabat or Chothia defined CDRs. Identification of predicted CDRs using the amino acid sequence is well known in the field, such as in Martin, A. C. "Protein sequence and structure analysis of antibody variable domains," In Antibody Engineering, Vol. 2. Kontermann R., Dikel S., eds. Springer-Verlag, Berlin, p. 33-51 (2010). The amino acid sequence of the heavy and/or light chain variable domain may be also inspected to identify the sequences of the CDRs by other conventional methods, e.g., by comparison to known amino acid sequences of other heavy and light chain variable regions to determine the regions of sequence hypervariability. The numbered sequences may be aligned by eye, or by employing an alignment program such as one of the CLUSTAL suite of programs, as described in Thompson, 1994, Nucleic Acids Res. 22: 4673-80. Molecular models are conventionally used to correctly delineate framework and CDR regions and thus correct the sequence-based assignments.

In some embodiments, CDR/FR of an immunoglobulin light or heavy chain is determined based on an IMGT definition (Lefranc et al. Dev. Comp. Immunol., 2003, 27(1):55-77; website: imgt.org).

In some embodiments, the multispecific antigen-binding proteins of the disclosure comprise 3 variable heavy chain CDRs (HCDRs) from any one of the variable heavy chain sequences recited in Tables 2, 3, and 4. in some embodiments, the multispecific antigen-binding proteins of the disclosure comprise 3 variable light chain CDRs (LCDRs)

from any one of the variable light chain sequences recited in Tables 2, 3, and 4. In some embodiments, the multispecific antigen-binding proteins of the disclosure comprise 3 HCDRs from any one of the variable heavy chain sequences recited in Tables 2, 3, and 4 and 3 LCDRs from any one of the variable light chain sequences recited in Tables 2, 3, and 4. The CDR sequences from the heavy and light chain variable sequences of Tables 2, 3, and 4 are readily determinable by those with skill in the art using art-recognized methods of identifying CDR sequences.

The term "Fc," as used herein, refers to a molecule comprising the sequence of a non-antigen-binding fragment resulting from digestion of an antibody or produced by other means, whether in monomeric or multimeric form, and can contain the hinge region. The original immunoglobulin source of the native Fc is typically of human origin and can be any of the immunoglobulins, although IgG1 and IgG2 are used in exemplary embodiments. Fc molecules are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, and IgE) or subclass (e.g., IgG1, IgG2, IgG3, IgA1, and IgA2). One example of a Fc is a disulfide-bonded dimer resulting from papain digestion of an IgG. The term "native Fc," as used herein, is generic to the monomeric, dimeric and multimeric forms.

A Fab fragment typically includes one light chain and the VH and CH1 domains of one heavy chain, wherein the VH-CH1 heavy chain portion of the F(ab) fragment cannot form a disulfide bond with another heavy chain polypeptide. As used herein, a Fab fragment can also include one light chain containing two variable domains separated by an amino acid linker and a CL domain, and one heavy chain containing two variable domains separated by an amino acid linker and a CH1 domain.

A F(ab') fragment typically includes one light chain and a portion of one heavy chain that contains more of the constant region (between the CH1 and CH2 domains), such that an interchain disulfide bond can be formed between two heavy chains to form a F(ab')2 molecule.

The term "binding protein," as used herein refers to a non-naturally occurring (or recombinant, engineered, or substituted) molecule that specifically binds to at least one target antigen.

As used herein, the term "Tm" refers to the melting temperature of a binding protein, an antigen-binding protein, an antibody and is a parameter critical for the thermal stability of antigen-binding proteins. The Tm commonly refers to the thermal stability of the Fv fragment, i.e., a variable region heavy and light chain (VHNL). The Tm can be measured by differential scanning calorimetry (DSC) or differential scanning fluorimetry (DSF).

One embodiment of the disclosure provides binding proteins having biological and immunological specificity to between one and four target antigens and/or specificity to between one and four target epitopes. Another embodiment of the disclosure provides nucleic acid molecules comprising nucleotide sequences encoding polypeptide chains that form such binding proteins. Another embodiment of the disclosure provides expression vectors comprising nucleic acid molecules comprising nucleotide sequences encoding polypeptide chains that form such binding proteins. Yet another embodiment of the disclosure provides host cells that express such binding proteins (i.e., comprising nucleic acid molecules or vectors encoding polypeptide chains that form such binding proteins).

As used herein, the term "linker" refers to 0-100 contiguous amino acid residues. The linkers are, present or absent, and same or different. Linkers comprised in a protein or a polypeptide may all have the same amino acid sequence or may have different amino acid sequences.

In some embodiments, the peptide linker comprises the following sequence:

(SEQ ID NO: 2)
EPKSCDKTHTSPPSPAPELLGGPSTPPTPSPSGG.

In some embodiments, the term "linker" refers to 1-15 contiguous amino acid residues. Typically, a linker provides flexibility and spatial separation between two amino acids or between two polypeptide domains. A linker may be inserted between VH, VL, CH and/or CL domains to provide sufficient flexibility and mobility for the domains of the light and heavy chains depending on the format of the molecule, e.g., to fold into cross over dual variable region immunoglobulins. A linker is typically inserted at the transition between variable domains between variable and knockout domain, or between variable and constant domains, respectively, at the amino sequence level. The transition between domains can be identified because the approximate size of the immunoglobulin domains are well understood. The precise location of a domain transition can be determined by locating peptide stretches that do not form secondary structural elements such as beta-sheets or alpha-helices as demonstrated by experimental data or as can be determined by techniques of modeling or secondary structure prediction. In certain exemplary embodiments, the linker may be inserted between Fab domains to create a tandem Fab antibody. In particular embodiments, the linker may be inserted between the N terminus of a VH domain of a first Fab and the C terminus of a CH1 domain of a second Fab.

The identity and sequence of amino acid residues in the linker may vary depending on the type of secondary structural element(s) necessary to achieve in the linker. For example, glycine, serine and alanine are suitable for linkers having maximum flexibility. Certain combinations of glycine, proline, threonine and serine are useful if a more rigid and extended linker is desired. Any amino acid residue may be considered as a linker in combination with other amino acid residues to construct larger peptide linkers as needed depending on the desired properties.

In some embodiments, a linker comprises: a single glycine (Gly) residue; a diglycine peptide (Gly-Gly); a tripeptide (Gly-Gly-Gly); a peptide with four glycine residues (Gly-Gly-Gly-Gly; SEQ ID NO: 3); a peptide with five glycine residues (Gly-Gly-Gly-Gly-Gly; SEQ ID NO: 4); a peptide with six glycine residues (Gly-Gly-Gly-Gly-Gly-Gly; SEQ ID NO: 5); a peptide with seven glycine residues (Gly-Gly-Gly-Gly-Gly-Gly-Gly; SEQ ID NO: 6); and a peptide with eight glycine residues (Gly-Gly-Gly-Gly-Gly-Gly-Gly-Gly; SEQ ID NO: 7).

In some embodiments, a linker comprises small amino acids, like Gly, Ala or Ser.

In some embodiments, a linker comprises Gly (G) and Ser (S), or GS, GGS, GGGS (SEQ ID NO: 8) or GGGGS (SEQ ID NO: 9). In some embodiments, a linker comprises (Gly-Gly-Gly-Gly-Ser)$_2$ (i.e., (GGGGS)$_2$) (SEQ ID NO: 10). In some embodiments, a linker comprises (Gly-Gly-Gly-Gly-Ser)$_3$ (i.e., (GGGGS)$_3$) (SEQ ID NO: 11).

In some embodiments, a linker comprises Gly-Gly-Gly-Gly-Ser (SEQ ID NO: 9), the peptide Gly-Gly-Gly-Gly-Ser-Gly-Gly-Gly-Gly-Ser (SEQ ID NO: 10), the peptide Gly-Gly-Gly-Gly-Ser-Gly-Gly-Gly-Gly-Ser-Gly-Gly-Gly-Gly-Ser (SEQ ID NO: 11), and the peptide Gly-Gly-Ser-Gly-Ser-Ser-Gly-Ser-Gly-Gly (SEQ ID NO: 12).

In some embodiments, a linker comprises a single Ser residue; a single Val residue; a dipeptide selected from Arg-Thr, Gln-Pro, Ser-Ser, Thr-Lys, and Ser-Leu; or a polypeptide selected from Thr-Lys-Gly-Pro-Ser (SEQ ID NO: 13), Thr-Val-Ala-Ala-Pro (SEQ ID NO: 14), Gln-Pro-Lys-Ala-Ala (SEQ ID NO: 15), Gln-Arg-Ile-Glu-Gly (SEQ ID NO: 16); Ala-Ser-Thr-Lys-Gly-Pro-Ser (SEQ ID NO: 17), Arg-Thr-Val-Ala-Ala-Pro-Ser (SEQ ID NO: 18), Gly-Gln-Pro-Lys-Ala-Ala-Pro (SEQ ID NO: 19), His-Ile-Asp-Ser-Pro-Asn-Lys (SEQ ID NO: 20), and Asp-Lys-Thr-His-Thr (SEQ ID NO: 21).

In some embodiments, two tandem Fabs are linked through a (Gly-Gly-Gly-Gly-Ser)$_2$ linker (SEQ ID NO: 10).

In some embodiments having CODV-Fab portion wherein L1 and L2 are on the light chain and L3 and L4 are on the heavy chain, L1 is 3 to 12 amino acid residues in length, L2 is 3 to 14 amino acid residues in length, L3 is 1 to 8 amino acid residues in length, and L4 is 1 to 3 amino acid residues in length. In some embodiments, L1 is 5 to 10 amino acid residues in length, L2 is 5 to 8 amino acid residues in length, L3 is 1 to 5 amino acid residues in length, and L4 is 1 to 2 amino acid residues in length. In some embodiments, L1 is 7 amino acid residues in length, L2 is 5 amino acid residues in length, L3 is 1 amino acid residue in length, and L4 is 2 amino acid residues in length. In some embodiments, L1 is 10 amino acid residues in length, L2 is 10 amino acid residues in length, L3 is 0 amino acid residue in length, and L4 is 0 amino acid residues in length. In some embodiments, L1, L2, L3, and L4 each have an independently selected length from 0 to 15 amino acids (e.g., 0, 1, 2, 3, 4, 5, 6, 7, 8, 9, 10, 11, 12, 13, 14, or 15 amino acids), wherein at least two of the linkers have a length of 1 to 15 amino acids (e.g., 1, 2, 3, 4, 5, 6, 7, 8, 9, 10, 11, 12, 13, 14, or 15 amino acids). In some embodiments, L1, L2, L3, and L4 are Asp-Lys-Thr-His-Thr (SEQ ID NO: 21). In some embodiments, linker(s) comprise the sequence Gly-Gln-Pro-Lys-Ala-Ala-Pro (SEQ ID NO: 19). In some embodiments, L1 comprises the sequence Gly-Gln-Pro-Lys-Ala-Ala-Pro (SEQ ID NO: 19). In some embodiments, L1 comprises the sequence Gly-Gln-Pro-Lys-Ala-Ala-Pro (SEQ ID NO: 19), L2 comprises the sequence Thr-Lys-Gly-Pro-Ser-Arg (SEQ ID NO: 22), L3 comprises the sequence Ser, and L4 comprises the sequence Arg-Thr. In some embodiments, L3 comprises the sequence Gly-Gln-Pro-Lys-Ala-Ala-Pro (SEQ ID NO: 19). In some embodiments, L1 comprises the sequence Ser, L2 comprises the sequence Arg-Thr, L3 comprises the sequence Gly-Gln-Pro-Lys-Ala-Ala-Pro (SEQ ID NO: 19) and L4 comprises the sequence Thr-Lys-Gly-Pro-Ser-Arg (SEQ ID NO: 22).

In some embodiments, L1, L2, L3 and L4 each independently comprises a sequence selected from (Gly-Gly-Gly-Gly-Ser)$_n$ (wherein n is an integer between 0 and 5; SEQ ID NO: 23), Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Gly-Ser-Ser-Gly-Ser-Gly-Gly (SEQ ID NO: 12). In some embodiments, L1 comprises the sequence Gly-Gln-Pro-Lys-Ala-Ala-Pro (SEQ ID NO: 19), L2 comprises the sequence Thr-Lys-Gly-Pro-Ser (SEQ ID NO: 13), L3 comprises the sequence Ser, and L4 comprises the sequence Arg-Thr. In some embodiments, L1 comprises the sequence Gly-Gly-Gly-Gly-Ser-Gly-Gly-Gly-Gly-Ser (SEQ ID NO: 10), L2 comprises the sequence Gly-Gly-Gly-Gly-Ser-Gly-Gly-Gly-Gly-Ser (SEQ ID NO: 10), L3 is 0 amino acids in length, and L4 is 0 amino acids in length. In some embodiments, L1 comprises the sequence Gly-Gly-Ser-Gly-Ser-Ser-Gly-Ser-Gly-Gly (SEQ ID NO: 12), L2 comprises the sequence Gly-Gly-Ser-Gly-Ser-Ser-Gly-Ser-Gly-Gly (SEQ ID NO: 12), L3 is 0 amino acids in length, and L4 is 0 amino acids in length. In some embodiments, L1 comprises the sequence Gly-Gly-Gly-Gly-Ser-Gly-Gly-Gly-Gly-Ser-Gly-Gly-Gly-Gly-Ser (SEQ ID NO: 11), L2 is 0 amino acids in length, L3 comprises the sequence Gly-Gly-Gly-Gly-Ser-Gly-Gly-Gly-Gly-Ser-Gly-Gly-Gly-Gly-Ser (SEQ ID NO: 11), and L4 is 0 amino acids in length. In some embodiments, L1 and L2 are zero amino acids in length, and L3 and L4 each comprise a sequence independently selected from (Gly-Gly-Gly-Gly-Ser)$_n$ (wherein n is an integer between 0 and 5; SEQ ID NO: 23), Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Gly-Ser-Ser-Gly-Ser-Gly-Gly (SEQ ID NO: 12). In some embodiments, L3 and L4 are zero amino acids in length, and L1 and L2 each comprise a sequence independently selected from (Gly-Gly-Gly-Gly-Ser)$_n$ (wherein n is an integer between 0 and 5; SEQ ID NO: 23), Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Gly-Ser-Ser-Gly-Ser-Gly-Gly (SEQ ID NO: 12).

In some embodiments, linker(s) comprise a sequence derived from a naturally occurring sequence at the junction between an antibody variable domain and an antibody constant domain (e.g., as described in WO 2012/135345, incorporated by reference). For example, in some embodiments, the linker comprises a sequence found at the transition between an endogenous VH and CH1 domain, or between an endogenous VL and CL domain (e.g., kappa or lambda). In some embodiments, the linker comprises a sequence found at the transition between an endogenous human VH and CH1 domain, or between an endogenous human VL and CL domain (e.g., human kappa or lambda).

The examples listed above are not intended to limit the scope of the disclosure in any way, and linkers comprising randomly selected amino acids selected from the group consisting of valine, leucine, isoleucine, serine, threonine, lysine, arginine, histidine, aspartate, glutamate, asparagine, glutamine, glycine, and proline are suitable for use in the binding proteins described herein. For additional descriptions of linker sequences, see, e.g., WO 2012/135345, WO 2017/180913, incorporated by reference.

As used herein, the term "valency" refers to the number of binding sites of a binding protein, an epitope, an antigen-binding protein or an antibody. For example, the term "monovalent binding protein" refers to a binding protein that has one antigen-binding site. The term "bivalent binding protein" refers to a binding protein that has two binding sites. The term "trivalent binding protein" refers to a binding protein that has three binding sites. The term "tetravalent binding protein" refers to a binding protein that has four binding sites. In particular embodiments the divalent binding protein can bind to one antigen target. In other embodiments, the divalent binding protein can bind to two different antigen targets. In particular embodiments the trivalent binding protein can bind to one antigen target, i.e., is monospecific. In other embodiments, the trivalent binding protein can bind to two different antigen targets, i.e., is bispecific. In other embodiments, the trivalent binding protein can bind to three different antigen targets, i.e., is trispecific.

In particular embodiments the tetravalent binding protein can bind to one antigen target, i.e., is monospecific. In other embodiments, the tetravalent binding protein can bind to two different antigen targets, i.e., is bispecific. In other embodiments, the tetravalent binding protein can bind to three different antigen targets, i.e., is trispecific. In other embodiments, the tetravalent binding protein can bind to four different antigen targets, i.e., is tetraspecific.

As used herein, the term "specificity" refers to the number of binding specificities of a binding protein, an epitope, an antigen-binding protein or an antibody.

For example, the term "monospecific binding protein" refers to a binding protein that specifically binds to one antigen target. The term "bispecific binding protein" refers to a binding protein that specifically binds to two different antigen targets. The term "trispecific binding protein" refers to a binding protein that specifically binds to three different antigen targets. The term "tetraspecific binding protein" refers to a binding protein that specifically binds to four different antigen targets and so forth.

As used herein, the term "selective recognition site" refers to a modification in the binding protein allowing to be selectively recognized by an affinity reagent binding to the selective recognition site. Examples of a selective recognition site comprise the binding site for protein A in the Fc part of an immunoglobulin.

As used herein, the term "affinity reagent" refers to a reagent that contains a ligand that is immobilized on a matrix and specifically binds to surface groupings of molecules such as amino acids or sugar side chains and usually have specific three-dimensional structural characteristics, as well as specific charge characteristics. Affinity reagents are tools in affinity chromatography, where purification is enabled by the specific interaction between the ligand and the product. "Protein L," which is an example of an affinity reagent, refers to recombinant protein L that is immobilized on a matrix to form a ligand that has affinity for a subset of the variable domain of immunoglobulin kappa light chains. Such matrices can be resin. Another example of an affinity reagent is "KappaSelect," which refers to a recombinant 13 kDa camelid-derived single chain antibody that is immobilized onto a matrix to form a ligand that has affinity for the constant domain of human immunoglobulin kappa light chains. Another example of an affinity reagent is Protein A. Protein A is a 42 kDa surface protein originally found in the cell wall of the bacteria *Staphylococcus aureus*. It has been shown via crystallographic refinement that the primary binding site for protein A is on the Fc region, between the CH2 and CH3 domains. In addition, protein A has been shown to bind human IgG molecules containing IgG F(ab')2 fragments from the human VH3 gene family. Protein A can bind with strong affinity to the Fc portion of immunoglobulin of certain species.

The dissociation constant (KD) of a binding protein can be determined, for example, by surface plasmon resonance. Generally, surface plasmon resonance analysis measures real-time binding interactions between ligand (a target antigen on a biosensor matrix) and analyte (a binding protein in solution) by surface plasmon resonance (SPR) using the BIAcore system (Pharmacia Biosensor; Piscataway, NJ). Surface plasmon analysis can also be performed by immobilizing the analyte (binding protein on a biosensor matrix) and presenting the ligand (target antigen). The term "KD," as used herein, refers to the dissociation constant of the interaction between a particular binding protein and a target antigen.

As used herein, the term "specifically binds" refers to the ability of a binding protein or an antigen-binding fragment thereof to bind to an antigen containing an epitope with an Kd of at least about $1\times10^{-6}$ M, $1\times10^{-7}$ M, $1\times10^{-8}$ M, $1\times10^{-9}$ M, $1\times10^{-10}$ M, $1\times10^{-11}$ M, $1\times10^{-12}$ M, or more, and/or to bind to an epitope with an affinity that is at least two-fold greater than its affinity for a nonspecific antigen. Binding affinity of an antigen to a binding protein or an antibody can be conducted by surface plasmon resonance (SPR) using a BIAcore instrument.

As used herein, the term "nucleic acid" refers to polymeric or oligomeric macromolecules, or large biological molecules, essential for all known forms of life. Nucleic acids, which include DNA (deoxyribonucleic acid) and RNA (ribonucleic acid), are made from monomers known as nucleotides. Most naturally occurring DNA molecules consist of two complementary biopolymer strands coiled around each other to form a double helix. The DNA strand is also known as polynucleotides consisting of nucleotides. Each nucleotide is composed of a nitrogen-containing nucleobase as well as a monosaccharide sugar called deoxyribose or ribose and a phosphate group. Naturally occurring nucleobases comprise guanine (G), adenine (A), thymine (T), uracil (U) or cytosine (C). The nucleotides are joined to one another in a chain by covalent bonds between the sugar of one nucleotide and the phosphate of the next, resulting in an alternating sugar-phosphate backbone. If the sugar is deoxyribose, the polymer is DNA. If the sugar is ribose, the polymer is RNA. Typically, a polynucleotide is formed through phosphodiester bonds between the individual nucleotide monomers.

As used herein, the term "polynucleotide" refers to single-stranded or double-stranded nucleic acid polymers of at least 10 nucleotides in length. It is understood that the nucleotides comprising the polynucleotide can be ribonucleotides or deoxyribonucleotides or a modified form of either type of nucleotide. Such modifications include base modifications such as bromuridine, ribose modifications such as arabinoside and 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate. The term "polynucleotide" specifically includes single-stranded and double-stranded forms of DNA.

An "isolated polynucleotide" is a polynucleotide of genomic, cDNA, or synthetic origin or some combination thereof, which: (1) is not associated with all or a portion of a polynucleotide in which the isolated polynucleotide is found in nature; (2) is linked to a polynucleotide to which it is not linked in nature; or (3) does not occur in nature as part of a larger sequence.

An "isolated polypeptide" is one that: (1) is free of at least some other polypeptides with which it would normally be found; (2) is essentially free of other polypeptides from the same source, e.g., from the same species; (3) is expressed by a cell from a different species; (4) has been separated from at least about 50 percent of polynucleotides, lipids, carbohydrates, or other materials with which it is associated in nature; (5) is not associated (by covalent or noncovalent interaction) with portions of a polypeptide with which the "isolated polypeptide" is associated in nature; (6) is operably associated (by covalent or noncovalent interaction) with a polypeptide with which it is not associated in nature; or (7) does not occur in nature. Such an isolated polypeptide can be encoded by genomic DNA, cDNA, mRNA or other RNA, of synthetic origin, or any combination thereof. In exemplary embodiments, the isolated polypeptide is substantially free from polypeptides or other contaminants that are found in its natural environment that would interfere with its use (therapeutic, diagnostic, prophylactic, research or otherwise).

As used herein, the term "expression vector" also referred to as an expression construct, usually refers to a plasmid or virus designed for protein expression in cells. The term "vector" refers to a protein or a polynucleotide or a mixture thereof which is capable of being introduced or of introducing proteins and/or nucleic acids comprised therein into a cell. Examples of vectors include but are not limited to plasmids, cosmids, phages, viruses or artificial chromosomes. In particular, a vector is used to transport a gene product of interest, such as e.g., foreign or heterologous DNA into a suitable host cell. Vectors may contain "replicon" polynucleotide sequences that facilitate the autonomous replication of the vector in a host cell. Foreign DNA is defined as heterologous DNA, which is DNA not naturally found in the host cell, which, for example, replicates the vector molecule, encodes a selectable or screenable marker, or encodes a transgene. Once in the host cell, the vector can replicate independently of or coincidental with the host chromosomal DNA, and several copies of the vector and its inserted DNA can be generated. In addition, the vector can also contain the necessary elements that permit transcription of the inserted DNA into an mRNA molecule or otherwise cause replication of the inserted DNA into multiple copies of RNA. Vectors may further encompass "expression control sequences" that regulate the expression of the gene of interest. Typically, expression control sequences are polypeptides or polynucleotides such as but not limited to promoters, enhancers, silencers, insulators, or repressors. In a vector comprising more than one polynucleotide encoding for one or more gene products of interest, the expression may be controlled together or separately by one or more expression control sequences. More specifically, each polynucleotide comprised on the vector may be control by a separate expression control sequence or all polynucleotides comprised on the vector may be controlled by a single expression control sequence. Polynucleotides comprised on a single vector controlled by a single expression control sequence may form an open reading frame. Some expression vectors additionally contain sequence elements adjacent to the inserted DNA that increase the half-life of the expressed mRNA and/or allow translation of the mRNA into a protein molecule. Many molecules of mRNA and polypeptide encoded by the inserted DNA can thus be rapidly synthesized.

As used herein, the term "host cell" refers to a cell into which a recombinant expression vector has been introduced. A recombinant host cell or host cell is intended to refer not only to the particular subject cell, but also to the progeny of such a cell. Because certain modifications may occur in succeeding generations due to either mutation or environmental influences, such progeny may not, in fact, be identical to the parent cell, but such cells are still included within the scope of the term "host cell" as used herein. A wide variety of host cell expression systems can be used to express the binding proteins, including bacterial, yeast, baculoviral, and mammalian expression systems (as well as phage display expression systems). An example of a suitable bacterial expression vector is pUC19. To express a binding protein recombinantly, a host cell is transformed or transfected with one or more recombinant expression vectors carrying DNA fragments encoding the polypeptide chains of the binding protein such that the polypeptide chains are expressed in the host cell and, in exemplary embodiments, secreted into the medium in which the host cells are cultured, from which medium the binding protein can be recovered.

As used herein, the term "pharmaceutical composition" refers to a compound or composition capable of inducing a desired therapeutic effect when properly administered to a subject, e.g., a human subject.

The term "pharmaceutically acceptable carrier" or "physiologically acceptable carrier," as used herein, refers to one or more formulation materials suitable for accomplishing or enhancing the delivery of a binding protein.

The terms "effective amount" and "therapeutically effective amount," when used in reference to a pharmaceutical composition comprising one or more binding proteins (e.g., antibodies or antigen-binding fragments thereof), refer to an amount or dosage sufficient to produce a desired therapeutic result. More specifically, a therapeutically effective amount is an amount of a binding protein (e.g., an antibody or antigen-binding fragment thereof) sufficient to inhibit, for some period of time, one or more of the clinically defined pathological processes associated with the condition being treated. The effective amount may vary depending on the specific antibody-like binding protein that is being used, and also depends on a variety of factors and conditions related to the patient being treated and the severity of the disorder. For example, if the binding protein or multispecific binding protein is to be administered in vivo, factors such as the age, weight, and health of the patient as well as dose response curves and toxicity data obtained in preclinical animal work would be among those factors considered. The determination of an effective amount or therapeutically effective amount of a given pharmaceutical composition is well within the ability of those skilled in the art.

As used herein, the term "method of production of a binding protein" refers to recombinant methods of protein expression using techniques well known in the art.

II. CH1/CL Mutations to Facilitate Pairing

In certain embodiments, mutations may be made in the CH1 and CL interface to facilitate specific pairing and prevent CH1/CL mispairing. Such mutations are described below and in further detail in WO2013/005194 and Golay et al. (2016) J. Immunol. Vol. 196. Pg. 3199-3211, each of which is incorporated herein by reference.

A first set of mutations may be made to a pair of interacting polar interface amino acids in the CH1 and CL domain. Said polar amino acids can be exchanged for a pair of neutral and salt-forming amino acids. In a certain embodiment, a first set of mutations may comprise a T192E CH1 mutation and a N137K, S114A CL kappa mutation. The T192E CH1 mutation and the N137K CL kappa mutation form a salt bridge, which may reinforce the specificity of association, whereas an unwanted pairing should be avoided by the lack of steric and charge complementarity between the wild-type and variant CH1 and CL kappa domains. Additionally, the S114A mutation on the CL kappa domain is made to avoid steric clashes with the bigger lysine side chain. The CH1 T192E and CL N137K/S114A mutation set may alternatively be referred to as the "CR3" mutation set.

A second set of mutations may be made to a pair of interacting hydrophobic and polar interface amino acid residues in the CH1 and CL kappa domains. One mutation may constitute a switch from a hydrophobic to polar interaction. In a certain embodiment, the second set of mutations may comprise a L143Q, S188V CH1 mutation and a V133T, S176V CL kappa mutation. The L134Q CH1 mutation and V133T CL kappa mutation constitutes a switch from a hydrophobic interaction to a polar interaction. The simultaneous S188V CH1 mutation and S176V CL kappa mutation constitutes a switch from a polar interaction to a hydrophobic interaction. The exchange of the polar/hydrophobic character of the interface interactions is expected to keep the affinity between the mutated CH1 and CL kappa domains unchanged, while decreasing their respective affinity for other wild-type counterpart CH1 and CL kappa domains, thus preventing mispairing by virtue of unfavorable interactions occurring upon mismatched (variant/wild-type) domains. The CH1 L143Q/S188V and CL V133T/S176V mutation set may alternatively be referred to as the "MUT4" mutation set.

A third and fourth set of mutations are "knob into holes" mutations. More specifically, in the third set of mutations (KH1), a L124A, L143E CH1 mutation is made and a V133W CL kappa mutation is made. In the fourth set of mutations (KH2), a V190A CH1 mutation is made and a L135W, N137A CL kappa mutation is made. The first, second, third, and fourth sets of mutations are described in further detail in WO2013/005194 A1.

A fifth and sixth set of mutations may be made to swap electrostatic charges in the CH1 and CL kappa domains. In a certain embodiment, the fifth set of mutations may comprise a K221E CH1 mutation and a E123K CL kappa mutation. The fifth set of mutations may be alternatively referred to as the "K221E/E123K opposite charge" mutation set or the "NN1" mutation set. In a certain embodiment, the sixth set of mutations may comprise a K228D CH1 mutation and a D122K CL kappa mutation. The sixth set of mutations may be alternatively referred to as the "K228D/D122K opposite charge" mutation set or the "NN2" mutation set. The fifth and sixth set of mutations are described in further detail in WO2007/147901 A1. In certain embodiments, the "K221E/E123K opposite charge" mutation set and the "K228D/D122K opposite charge" mutation set may be combined. Accordingly, the combination may comprise a K221E and K228D CH1 mutation pair and a E123K and D122K CL kappa mutation pair. The combined set of mutations may be alternatively referred to as the "K221E: K228D/E123K: D122K opposite charge" mutation set or the "NN3" mutation set.

A seventh and eighth set of mutations may be made to swap electrostatic charges in the CH1 and CL kappa domains. In a certain embodiment, the seventh set of mutations may comprise a L143E, L143D, L143R, L143K, or L143H CH1 mutation and a S176E, S176D, S176R, S176K, or S176H CL kappa mutation, provided that the CH1 mutation is of an opposite charge from the CL kappa mutation. The seventh set of mutations may be alternatively referred to as the "L143/S176 opposite charge" mutation set. In certain embodiments, a CH1 L143E or L143D mutation may be paired with a CL S176R or S176K mutation, and may be referred to as a "CM3" mutation set. In certain embodiments, a CH1 L143R or L143K mutation may be paired with a CL S176E or S176D mutation, and may be referred to as a "CM4" mutation set. In a certain embodiment, the eighth set of mutations may comprise a L124E, L124D, L124R, L124K, or L124H CH1 mutation and a V133E, V133D, V133R, V133K, or V133H CL kappa mutation, provided that the CH1 mutation is of an opposite charge from the CL kappa mutation. The eighth set of mutations may be alternatively referred to as the "L124/V133 opposite charge" mutation set. In certain embodiments, a CH1 L124E or L124D mutation may be paired with a CL V133R or V133K mutation, and may be referred to as a "CM5" mutation set. In certain embodiments, a CH1 L124R or L124K mutation may be paired with a CL V133E or V133D mutation, and may be referred to as a "CM6" mutation set.

In further embodiments, any one or more of the above mentioned mutations may be combined with each other's and/or with mutations described below. As an example, the CH1 domain of a first Fab comprises a T192E, K221E mutation and the CL kappa domain of a first Fab comprises a E123K, N137K, S114A mutation. The CH1 domain of a second Fab may further comprise a L143Q, S188V mutation and the CL kappa domain of a second Fab may comprise a V133T, S176V mutation. Alternatively, the second Fab may be wild-type.

Sequence position numbers used herein for the CH1 and CL kappa domains refer to Kabat numbering (Kabat, E. A. et al., Sequences of proteins of immunological interest. 5th Edition—US Department of Health and Human Services, NIH publication no 91-3242, pp 662,680,689, 1991).

III. VH/VL Opposite Charge Mutations to Facilitate Pairing

In certain embodiments, mutations may be made in the VH and VL interface to facilitate specific pairing and prevent VH/VL mispairing. In particular embodiments, the mutations made to the VH and VL domains introduce opposite charged amino acid residues to promote heterodimerization through electrostatic interactions.

In a certain embodiment, a set of opposite charge mutations may comprise a mutation in the VH domain at Kabat position 39 and a mutation in the VL domain at Kabat position 38. Any known positively charged or negatively charged residue may be introduced at the VH Kabat position 39, provided that the mutation introduced at the VL Kabat position 38 is of an opposite charge. For example, one possible mutated pair comprises a VH K39 mutated residue (introducing a positive charge) and a VL E38 mutated residue (introducing a negative charge). Alternatively, the reverse mutation set may be made, where a VH E39 mutated residue (introducing a negative charge) and a VL K38 mutated residue (introducing a positive charge) are introduced. In certain embodiments, the VH domain may comprise at Kabat position 39 a residue mutated into a E, D, K, R, or H and the VL domain may comprise at Kabat position 38 a residue mutated into a E, D, K, R, or H, provided that the mutated residue in the VH domain is an opposite charge from the mutated residue in the VL domain. For instance, when the VH domain comprises a mutated residue E or D at Kabat position 39, then the VL domain comprises a mutated residue K, R or H at Kabat position 38. Alternatively, when the VH domain comprises a mutated residue K, R or H at Kabat position 39, then the VL domain comprises a mutated residue E or D at Kabat position 38. In a certain embodiment wherein two VHNL pairs are not in the same polypeptide chain, if one VHNL pair comprises a positive charge in VH39 (e.g. E or D) and a negative charge in VL38 (e.g. K, R or H), then the another VHNL pair may comprise a negative charge in VH39 (e.g. K, R or H) and a positive charge in VL38 (e.g. E or D). For example, if a first VHNL pair comprises VH39K and VL38E mutations, then a second VH/VL pair may comprise VH39E and VL38K mutations. This set of opposite charge mutations may be alternatively referred to as the "VH39/VL38 opposite charge" mutation set. This set of opposite charged mutations are described in further detail in Tan et al., Biophysical Journal. Vol. 75. Pg. 1473-1482, 1998.

In a certain embodiment, a set of opposite charge mutations may comprise a Q39 mutation in the VH domain and a Q38 mutation in the VL domain. Any known positively charged or negatively charged residue may be introduced at the VH Q39 position, provided that the mutation introduced at the VL Q38 position is of an opposite charge. For example, one possible mutation pair comprises a VH Q39K mutation (introducing a positive charge) and a VL Q38E mutation (introducing a negative charge). Alternatively, the reverse mutation set may be made, where a VH Q39E mutation (introducing a negative charge) and a VL Q38K mutation (introducing a positive charge) are introduced. In certain embodiments, the VH domain may comprise a Q39E, Q39D, Q39K, Q39R, or Q39H mutation and the VL domain may comprise a Q38E, Q38D, Q38K, Q38R, or Q38H mutation, provided that the mutation in the VH domain is an opposite charge from the mutation in the VL domain.

In further embodiments, any one or more of the above mentioned mutations may be combined with each other's and/or with mutations described below.

IV. VH/VL Disulfide Stabilization Mutations

In certain embodiments, mutations may be made in the VH and VL interface to improve stability between the VH/VL interface. Specific sets of amino acid mutations in the VH domain and the VL domains may improve stability through the introduction of non-native cysteine residues that form disulfide bridges.

A first set of disulfide-stabilizing mutations may be made to amino acid residues in the VH and VL domains. In a certain embodiment, the first set of disulfide stabilizing mutations may comprise a 44C mutation in the VH domain and a 100O mutation in the VL domain. The first set of disulfide stabilizing mutations may be alternatively referred to as the "VH44C/VL100O" mutation set. The first set of disulfide stabilizing mutations are described in further detail in Reiter et al. Nature Biotechnology. Vol. 14. Pg. 1239-1245. 1996, incorporated herein by reference for all purposes.

A second set of disulfide stabilizing mutations may be made to amino acid residues in the VH and VL domain. In a certain embodiment, the second set of disulfide stabilizing mutations may comprise a 105C mutation in the VH domain and a 43C mutation in the VL domain. The second set of disulfide stabilizing mutations may be alternatively referred to as the "VH105C/VL43C" mutation set. The second set of disulfide stabilizing mutations are described in further detail in U.S. Pat. No. 9,527,927, incorporated herein by reference for all purposes.

V. Antibody Mutation Combinations

In certain embodiments, combinations of mutation sets may be in the CH1 and CL kappa interface and/or in the VH and VL interface to further facilitate pairing and improve stability.

In a particular embodiment, a first Fab domain in an antibody may comprise one or both of the CR3 and MUT4 mutation set in combination with a VH/VL opposite charge mutation set. In a further embodiment, a second Fab domain in an antibody may comprise one or both of the CR3 and MUT4 mutation set in combination with a VH/VL opposite charge mutation set.

In particular embodiments, a first Fab domain may comprise one or both of the CR3 and MUT4 mutation set in combination with a VH/VL opposite charge mutation set and a disulfide stabilizing mutation set. In a further embodiment, a second Fab domain in an antibody may comprise one or both of the CR3 and MUT4 mutation set in combination with a VH/VL opposite charge mutation set and a disulfide stabilizing mutation set.

Any of the above embodiments may further comprise a opposite charge mutation set in the CH1/CL interface. For example, a first Fab may comprise a K221E CH1 mutation and a E123K CL kappa mutation. A second Fab may comprise a K221E CH1 mutation and a E123K CL kappa mutation.

VI. Antibody Formats and Mutation Sets in the Same

Any of the above recited mutation sets and combinations thereof may be applied to the multispecific antigen binding protein described herein.

Cross-Over Dual Variable

In a particular embodiment, "cross-over dual variable" or "CODV" refers to an antigen-binding domain that specifically binds to at least one target antigen or at least one target epitope, and comprises at least two polypeptide chains that form at least two antigen-binding sites, wherein at least one polypeptide chain comprises a structure represented by the formula:

VL1-L1-VL2-L2-CL  [I]

and at least one polypeptide chain comprises a structure represented by the formula:

VH2-L3-VH1-L4-CH1  [II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain; and
L1, L2, L3, and L4 are amino acid linkers, and
wherein the polypeptides of formula I and the polypeptides of formula II form a cross-over light chain-heavy chain pair.

In a particular embodiment, a CODV antigen-binding domain specifically binds to at least one target antigen or at least one target epitope, and comprises four polypeptide chains that form four antigen-binding sites, wherein two polypeptide chains each comprises a structure represented by the formula:

VL1-L1-VL2-L2-CL  [I]

and two polypeptide chains each comprises a structure represented by the formula:

VH2-L3-VH1-L4-CH1-Fc  [II]

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain;
Fc is an immunoglobulin hinge region and CH2 and CH3 immunoglobulin heavy chain constant domains; and
L1, L2, L3, and L4 are amino acid linkers, and
wherein the polypeptides of formula I and the polypeptides of formula II form a cross-over light chain-heavy chain pair,
wherein the VH1/VL1 pair comprises a first antigen binding specificity and the VH2/VL2 pair comprises a second antigen binding specificity.

In a particular embodiment, an antigen-binding protein described herein is a trispecific and/or a trivalent antigen-binding protein comprising four polypeptide chains that form three antigen-binding sites that specifically bind to one or more different antigen targets, wherein the first polypeptide chain comprises a structure represented by the formula:

VL2-L1-VL1-L2-CL [I]

the second polypeptide chain comprises a structure represented by the formula:

VH1-L3-VH2-L4-CH1-hinge-CH2-CH3 [II]

the third polypeptide chain comprises a structure represented by the formula:

VH3-CH1-hinge-CH2-CH3 [III]

and the fourth polypeptide chain comprises a structure represented by the formula:

VL3-CL [IV], wherein:
VL1 is a first immunoglobulin light chain variable domain;
VL2 is a second immunoglobulin light chain variable domain;
VL3 is a third immunoglobulin light chain variable domain;
VH1 is a first immunoglobulin heavy chain variable domain;
VH2 is a second immunoglobulin heavy chain variable domain;
VH3 is a third immunoglobulin heavy chain variable domain;
CL is an immunoglobulin light chain constant domain;
CH1 is an immunoglobulin CH1 heavy chain constant domain;
CH2 is an immunoglobulin CH2 heavy chain constant domain;
CH3 is an immunoglobulin CH3 heavy chain constant domain;
hinge is an immunoglobulin hinge region connecting the CH1 and CH2 domains; and
L1, L2, L3, and L4 are amino acid linkers, and
wherein the polypeptides of formula I and the polypeptides of formula II form a cross-over light chain-heavy chain pair.

In certain embodiments, the first polypeptide chain and the second polypeptide chain have a cross-over orientation that forms two distinct antigen-binding sites. In some embodiments, the VH1 and VL1 form a binding pair and form the first antigen-binding site. In some embodiments, the VH2 and VL2 form a binding pair and form the second antigen-binding site. In some embodiments, the third polypeptide and the fourth polypeptide form a third antigen-binding site. In some embodiments, the VH3 and VL3 form a binding pair and form the third antigen-binding site.

Such antigen-binding protein comprises at least three antigen-binding sites. It is at least a trivalent antigen-binding molecule. In a particular embodiment, it specifically binds to one antigen target, i.e., it is a monospecific antigen-binding molecule. In another embodiment, it specifically binds to two different antigen targets, i.e., it is a bispecific antigen-binding molecule. In another embodiment, it specifically binds to three different antigen targets, i.e., it is a trispecific antigen-binding molecule.

The examples listed above are not intended to limit the scope of the invention in any way, and linkers comprising randomly selected amino acids selected from the group consisting of valine, leucine, isoleucine, serine, threonine, lysine, arginine, histidine, aspartate, glutamate, asparagine, glutamine, glycine, and proline have been shown to be suitable in the antibody-like binding proteins described herein.

The CODV antibody format, the various permutations of the CODV antibody format, and additional details regarding linkers is further described in WO 2012/135345A1, and WO 2017/180913A2, which are incorporated herein by reference in their entireties.

Tandem Fabs

In a particular embodiment, "tandem Fabs" refers to an antigen-binding protein, wherein the C terminus of one CH1 region of a first Fab domain is operatively linked to the N terminus of a VH region of a second Fab domain. In certain embodiments, the tandem fab antibody may be tetravalent and monospecific (each of the four Fabs binding the same antigen). In certain embodiments, the tandem fab antibody may be tetravalent and bispecific (two of the four Fabs bind a first antigen or epitope while the other two fabs bind a second antigen or epitope).

The tandem fabs may be operatively linked with any known peptide linker to the art used for linking two or more antigen-bind domains. In a particular embodiment, the peptide linker is a Gly-Ser linker, i.e., a linker comprising only glycine amino acid(s) and serine amino acid(s). In a particular embodiment, the peptide linker is a (Gly-Gly-Gly-Gly-Ser)$_n$ (SEQ ID NO: 1) linker, wherein n is any integer from 1 to 5. In a particular embodiment, the peptide linker is a (Gly-Gly-Gly-Gly-Ser)$_3$ (SEQ ID NO: 11) linker. In a particular embodiment, the peptide linker is a (Gly-Gly-Gly-Gly-Ser)$_2$ (SEQ ID NO: 10) linker.

Alternatively, or in combination with the above recited Gly-Ser linker, the peptide linker may comprise all or part of the sequence of the hinge region of one or more immunoglobulins selected from IgA, IgG, and IgD. Sequences of hinge regions of human IgG, IgA and IgD are indicated below:

IgA1 (SEQ ID NO: 24):
Val-Pro-Ser-Thr-Pro-Pro-Thr-Pro-Ser-Pro-Ser-Thr-
Pro-Pro-Thr-Pro-Ser-Pro-Ser.

IgA2 (SEQ ID NO: 25):
Val-Pro-Pro-Pro-Pro-Pro.

IgD (SEQ ID NO: 26):
Glu-Ser-Pro-Lys-Ala-Gln-Ala-Ser-Ser-Val-Pro-Thr-
Ala-Gln-Pro-Gln-Ala-Glu-Gly-Ser-Leu-Ala-Lys-Ala-
Thr-Thr-Ala-Pro-Ala-Thr-Thr-Arg-Asn-Thr-Gly-Arg-

-continued
```
Gly-Gly-Glu-Glu-Lys-Lys-Lys-Glu-Lys-Glu-Lys-Glu-
Glu-Gln-Glu-Glu-Arg-Glu-Thr-Lys-Thr-Pro.

IgG1 (SEQ ID NO: 27):
Glu-Pro-Lys-Ser-Cys-Asp-Lys-Thr-His-Thr-Cys-Pro-
Pro-Cys-Pro.

IgG2 (SEQ ID NO: 28):
Glu-Arg-Lys-Cys-Cys-Val-Glu-Cys-Pro-Pro-Cys-Pro.

IgG3 (full-length sequence disclosed as (SEQ
ID NO: 31):
Glu-Leu-Lys-Thr-Pro-Leu-Gly-Asp-Thr-Thr-His-Thr-
Cys-Pro-Arg-Cys-Pro (SEQ ID NO: 29) followed
by 0 or 1 to 4 repeats of Glu-Pro-Lys-Ser-Cys-
Asp-Thr-Pro-Pro-Pro-Cys-Pro-Arg-Cys-Pro (SEQ ID
NO: 30).

IgG4:
                                        (SEQ ID NO: 32)
Glu-Ser-Lys-Tyr-Gly-Pro-Pro-Cys-Pro-Ser-Cys-Pro.
```

Said peptide linker may comprise all or part of the sequence of the hinge region of only one immunoglobulin. In this case, said immunoglobulin may belong to the same isotype and subclass as the immunoglobulin from which the adjacent CH1 domain is derived, or to a different isotype or subclass.

Alternatively, said peptide linker may comprise all or part of the sequences of hinge regions of at least two immunoglobulins of different isotypes or subclasses. In this case, the N-terminal portion of the peptide linker, which directly follows the CH1 domain, may consist of all or part of the hinge region of an immunoglobulin belonging to the same isotype and subclass as the immunoglobulin from which said CH1 domain is derived. Optionally, said peptide linker may further comprise a sequence of from 2 to 15 or from 5 to 10 N-terminal amino-acids of the CH2 domain of an immunoglobulin.

In certain embodiments, sequences from native hinge regions can be used. In other embodiments, point mutations can be brought to these sequences, in particular the replacement of one or more cysteine residues in native IgG1, IgG2 or IgG3 hinge sequences by alanine or serine, in order to avoid unwanted intra-chain or inter-chains disulfide bonds.

A non-limiting example of a peptide linker which can be used in the antigen-binding proteins of the disclosure is a peptide linker having the following sequence: Glu-Pro-Lys-Ser-Cys-Asp-Lys-Thr-His-Thr-Cys-Pro-Pro-Cys-Pro-Ala-Pro-Glu-Leu-Leu-Gly-Gly-Pro-Ser-Thr-Pro-Pro-Thr-Pro-Ser-Pro-Ser-Gly-Gly (SEQ ID NO: 33). Said peptide linker consists of the full-length sequence of human IgG1 hinge, followed by the 9 N-terminal amino acids of human IgG1 CH2 (Ala-Pro-Glu-Leu-Leu-Gly-Gly-Pro-Ser, SEQ ID NO: 34), followed by a portion of the sequence of human IgA1 hinge (Thr-Pro-Pro-Thr-Pro-Ser-Pro-Ser, SEQ ID NO: 35), and by the dipeptide GG, added to provide supplemental flexibility to the linker (full-length sequence disclosed as SEQ ID NO: 36). In a particular embodiment, the peptide linker Glu-Pro-Lys-Ser-Cys-Asp-Lys-Thr-His-Thr-Cys-Pro-Pro-Cys-Pro-Ala-Pro-Glu-Leu-Leu-Gly-Gly-Pro-Ser-Thr-Pro-Pro-Thr-Pro-Ser-Pro-Ser-Gly-Gly (SEQ ID NO: 33) may have one or more cysteine residues replaced to eliminate disulfide bind formation. In a particular embodiment, the peptide linker comprises the following sequence: Glu-Pro-Lys-Ser-Cys-Asp-Lys-Thr-His-Thr-Ser-Pro-Pro-Ser-Pro-Ala-Pro-Glu-Leu-Leu-Gly-Gly-Pro-Ser-Thr-Pro-Pro-Thr-Pro-Ser-Pro-Ser-Gly-Gly (SEQ ID NO: 2). The hinge-derived peptide linkers are further described in WO 2013/005194 A2, which is incorporated herein by reference in its entirety.

VII. Exemplary Antibody Mutations and Antibody Format Combinations

Any of the above recited antibody mutations may be combined with any of the above recited antibody formats.

In a particular embodiment, the antigen-binding protein of the disclosure may comprise a CODV antibody format with one or more of the CR3 mutation sets, the MUT4 mutation set, the L143/S176 opposite charge mutation set, and the L124/V133 opposite charge mutation set. The antigen-binding protein may further comprise one or more VH/VL opposite charge mutation sets. The one or more VH/VL opposite charge mutation sets include, but are not limited to, the VH39NL38 opposite charge mutation set. The antigen-binding protein may further comprise one or more VH/VL disulfide stabilization mutation sets. The one or more VH/VL disulfide mutation sets include, but are not limited to, the VH44C/VL1000 mutation set and the VH105C/VL43C mutation set. The antigen-binding protein may further comprise one or more CH1/CL opposite charge mutation sets. The one or more CH1/CL opposite charge mutation sets may include, but are not limited to, the K221E/E123K opposite charge mutation set.

In a particular embodiment, an antigen-binding protein of the disclosure comprises two polypeptide chains and forming two antigen-binding sites, wherein one polypeptide chain has a structure represented by the formula:

$$\text{VL1-L1-VL2-L2-CL} \quad [\text{I}]$$

and one polypeptide chain have a structure represented by the formula:

$$\text{VH2-L3-VH1-L4-CH1} \quad [\text{II}]$$

wherein:
VL1 is a first immunoglobulin light chain variable domain;
VL2 is a second immunoglobulin light chain variable domain;
VH1 is a first immunoglobulin heavy chain variable domain;
VH2 is a second immunoglobulin heavy chain variable domain;
CL is an immunoglobulin light chain constant domain;
CH1 is an immunoglobulin CH1 heavy chain constant domain; and
L1, L2, L3, and L4 are amino acid linkers,
wherein the polypeptide of formula I and the polypeptide of formula II form a cross-over light chain-heavy chain pair,
wherein one or both of VH1 and VH2 comprise a VH44C mutation and one or both of VL1 and VL2 comprise a VL1000 mutation to form a disulfide bond,
wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2, and
wherein the CH1 domain comprises one or more of T192E, L143Q and S188V mutations and the CL domain comprises one or more of N137K, S114A, V133T and S176V mutations.

In a particular embodiment, the antigen-binding protein of the disclosure may comprise a tandem Fab antibody format with one or more of the CR3 mutation set, the MUT4 mutation set, the L143/S176 opposite charge mutation set, and the L124N133 opposite charge mutation set. The antigen-binding protein may further comprise one or more VH/VL opposite charge mutation sets. The one or more VH/VL opposite charge mutation sets include, but are not limited to, the VH39NL38 opposite charge mutation set. The antigen-binding protein may further comprise one or more VH/VL disulfide stabilization mutation sets. The one or more VH/VL disulfide mutation sets include, but are not limited to, the VH44C/VL100C mutation set and the VH105C/VL43C mutation set.

The antigen-binding protein may further comprise one or more CH1/CL opposite charge mutation sets. The one or more CH1/CL opposite charge mutation sets may include, but are not limited to, the K221E/E123K opposite charge mutation set.

In a particular embodiment, the multispecific antibody of the disclosure may comprise:
 a) a first light chain (LC1)/heavy chain (HC1) pair comprising:
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1; and
 b) a second light chain (LC2)/heavy chain (HC2) pair comprising:
  (3) a second VL region (VL2) paired with a second VH region (VH2) to form a second antigen-binding site; and
  (4) a second constant heavy chain region 1 (CH1-2) operatively linked to VH2 and a second constant light chain region (CL2) operatively linked to VL2,
 wherein the C terminus of CH1-1 is operatively linked to the N terminus of VH2, and
 wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2, and
 wherein one or both of the CH1-1 and CH1-2 domains comprise one or more of T192E, L143Q and S188V mutations and one or both of the CL1 and CL2 domains comprises one or more of N137K, S114A, V133T and S176V mutations,
 wherein the mutations in CH1-1 and CL1 to facilitate pairing are different from the mutations in CH1-2 and CL2 to facilitate pairing.

In a particular embodiment, the antigen-binding protein of the disclosure may comprise a traditional Y-shaped antibody format with one or more of the CR3 mutation set, the MUT4 mutation set, the L143/S176 opposite charge mutation set, and the L124N133 opposite charge mutation set. The antigen-binding protein may further comprise one or more VH/VL opposite charge mutation sets. The one or more VH/VL opposite charge mutation sets include, but are not limited to, the VH39NL38 opposite charge mutation set. The antigen-binding protein may further comprise one or more VH/VL disulfide stabilization mutation sets. The one or more VH/VL disulfide stabilization mutation sets include, but are not limited to, the VH44C/VL100C mutation set and the VH105C/VL43C mutation set. The antigen-binding protein may further comprise one or more CH1/CL opposite charge mutation sets. The one or more CH1/CL opposite charge mutation sets may include, but are not limited to, the K221E/E123K opposite charge mutation set.

In a particular embodiment, the multispecific antibody of the disclosure may comprise:
 a) a first light chain (LC1)/heavy chain (HC1) pair comprising
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1; and
  (3) a first heterodimerization domain (HD1); and
 b) a second light chain (LC2)/heavy chain (HC2) pair comprising
  (4) a second VL region (VL2) paired with a second VH region (VH2) to form a second antigen-binding site;
  (5) a second constant heavy chain region 1 (CH1-2) operatively linked to VH2 and a second constant light chain region (CL2) operatively linked to VL2; and
  (6) a second heterodimerization domain (HD2);
 wherein HD1 and HD2 heterodimerize,
 wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2,
 wherein one or both of the CH1-1 and CH1-2 domains comprise one or more of T192E, L143Q and S188V mutations and one or both of the CL1 and CL2 domains comprises one or more of N137K, S114A, V133T and S176V mutations, and
 wherein the mutations in CH1-1 and CL1 to facilitate pairing are different from the mutations in CH1-2 and CL2 to facilitate pairing.

In a particular embodiment, the multispecific antibody of the disclosure may comprise:
 a) a first light chain (LC1)/heavy chain (HC1) pair comprising
  (1) a first VL region (VL1) paired with first VH region (VH1) to form a first antigen-binding site;
  (2) a first constant heavy chain region 1 (CH1-1) operatively linked to VH1 and a first constant light chain region (CL1) operatively linked to VL1; and
  (3) a first heterodimerization domain (HD1); and
 b) a second light chain (LC2)/heavy chain (HC2) pair comprising
  (4) a second VL region (VL2) paired with a second VH region (VH2) to form a second antigen-binding site;
  (5) a second constant heavy chain region 1 (CH1-2) operatively linked to VH2 and a second constant light chain region (CL2) operatively linked to VL2; and
  (6) a second heterodimerization domain (HD2);
 wherein HD1 and HD2 heterodimerize,
 wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2, wherein one or both of the CH1-1 and CH1-2 domains comprise one or more of T192E, L143Q and S188V mutations and one or both of the CL1 and CL2 domains comprises one or more of N137K, S114A, V133T and S176V mutations, and wherein the mutations in CH1-1 and CL1 to facilitate pairing are different from the mutations in CH1-2 and CL2 to facilitate pairing, wherein one or both of the CH1-1 and CH1-2 domains further comprise a K221E mutation and one or both of the CL1 and CL2 domains further comprise a E123K mutation.

In a particular embodiment, the multispecific antibody of the disclosure may comprise:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);

wherein HD1 and HD2 heterodimerize, wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2, wherein one or both of the CH1-1 and CH1-2 domains comprise a L143E, a L143D, a L143K, a L143R, or a L143H mutation and one or both of the CL1 and CL2 domains comprises a S176E, a S176D, a S176K, a S176R, or a S176H mutation, and wherein the mutation in one of both of CH1-1 or CH1-2 is an opposite charge from the mutation in one or both of CL1 and CL2.

In a particular embodiment, the multispecific antibody of the disclosure may comprise:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);

wherein HD1 and HD2 heterodimerize, wherein one or both of VH1 and VH2 comprise a Q39E, a Q39D, a Q39K, a Q39R, or a Q39H mutation and one or both of VL1 and VL2 comprise a Q38E, a Q38D, a Q38K, a Q38R, or a Q38H mutation, wherein the mutation in one or both of VH1 and VH2 is an opposite charge from the mutation in one or both of VL1 and VL2, wherein one or both of the CH1-1 and CH1-2 domains comprise a L124E, a L124D, a L124K, a L124R, or a L124H mutation and one or both of the CL1 and CL2 domains comprises a V133E, a V133D, a V133K, a V133R, or a V133H mutation, and wherein the mutation in one of both of CH1-1 or CH1-2 is an opposite charge from the mutation in one or both of CL1 and CL2.

In a particular embodiment, the multispecific antibody of the disclosure may comprise:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);

wherein HD1 and HD2 heterodimerize, wherein the CH1-1 domain comprises a L143E or L143D mutation and the CL1 domain comprises a S176R or S176K mutation.

In a particular embodiment, the multispecific antibody of the disclosure may comprise:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);

wherein HD1 and HD2 heterodimerize, wherein the CH1-1 domain comprises a L143R or L143K mutation and the CL1 domain comprises a S176E or S176D mutation.

In a particular embodiment, the multispecific antibody of the disclosure may comprise:

a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and (3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CL1 domain comprises a S176R or S176K mutation,
wherein one or both of the CH1-1 and CH1-2 domains comprise a K221E mutation and one or both of the CL1 and CL2 domains comprise a E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143R or L143K mutation and the CL1 domain comprises a S176E or S176D mutation,
wherein one or both of the CH1-1 and CH1-2 domains comprise a K221E mutation and one or both of the CL1 and CL2 domains comprise a E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
wherein one or both of the CH1-1 and CH1-2 domains comprise a K221E mutation and one or both of the CL1 and CL2 domains comprise a E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CL1 domain comprises a S176R or S176K mutation,
wherein one or both of the CH1-1 and CH1-2 domains comprise a K228D mutation and one or both of the CL1 and CL2 domains comprise a D122K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143R or L143K mutation and the CL1 domain comprises a S176E or S176D mutation,
wherein one or both of the CH1-1 and CH1-2 domains comprise a K228D mutation and one or both of the CL1 and CL2 domains comprise a D122K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
wherein one or both of the CH1-1 and CH1-2 domains comprise a K228D mutation and one or both of the CL1 and CL2 domains comprise a D122K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CL1 domain comprises a S176R or S176K mutation,
wherein one or both of the CH1-1 and CH1-2 domains comprise a K221E and K228D mutation and one or both of the CL1 and CL2 domains comprise a D122K and E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143R or L143K mutation and the CL1 domain comprises a S176E or S176D mutation,
wherein one or both of the CH1-1 and CH1-2 domains comprise a K221E and K228D mutation and one or both of the CL1 and CL2 domains comprise a D122K and E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
wherein one or both of the CH1-1 and CH1-2 domains comprise a K221E and K228D mutation and one or both of the CL1 and CL2 domains comprise a D122K and E123K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising (4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143E or L143D mutation and the CL1 domain comprises a S176R or S176K mutation, wherein the VH1 domain comprises a VH39K mutation and the VL1 domain comprises a VL38E mutation.

In a particular embodiment, the multispecific antibody of the disclosure may comprise:

a) a first light chain (LC1)/heavy chain (HC1) pair comprising (1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and (3) a first heterodimerization domain (HD1); and b) a second light chain (LC2)/heavy chain (HC2) pair comprising (4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143R or L143K mutation and the CL1 domain comprises a S176E or S176D mutation, wherein the VH1 domain comprises a VH39E mutation and the VL1 domain comprises a VL38K mutation.

In a particular embodiment, the multispecific antibody of the disclosure may comprise:

a) a first light chain (LC1)/heavy chain (HC1) pair comprising (1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and (3) a first heterodimerization domain (HD1); and b) a second light chain (LC2)/heavy chain (HC2) pair comprising (4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation, wherein the VH1 domain comprises a VH39K mutation and the VL1 domain comprises a VL38E mutation.

In a particular embodiment, the multispecific antibody of the disclosure may comprise:

a) a first light chain (LC1)/heavy chain (HC1) pair comprising (1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and (3) a first heterodimerization domain (HD1); and b) a second light chain (LC2)/heavy chain (HC2) pair comprising (4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation, wherein the VH1 domain comprises a VH39K mutation and the VL1 domain comprises a VL38E mutation, wherein the VH2 domain comprises a VH39E mutation and the VL2 domain comprises a VL38K mutation.

In a particular embodiment, the multispecific antibody of the disclosure may comprise:

a) a first light chain (LC1)/heavy chain (HC1) pair comprising (1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and (3) a first heterodimerization domain (HD1); and b) a second light chain (LC2)/heavy chain (HC2) pair comprising (4) a second VL region (VL2) paired with a second VH region (VH2) to form a second antigen-binding site;

(5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143E or L143D mutation and the CL1 domain comprises a S176R or S176K mutation, wherein one or both of the CH1-1 and CH1-2 domains comprise a K221E mutation and one or both of the CL1 and CL2 domains comprise a E123K mutation, wherein the VH1 domain comprises a VH39K mutation and the VL1 domain comprises a VL38E mutation.

In a particular embodiment, the multispecific antibody of the disclosure may comprise:

a) a first light chain (LC1)/heavy chain (HC1) pair comprising (1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and (3) a first heterodimerization domain (HD1); and b) a second light chain (LC2)/heavy chain (HC2) pair comprising (4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143R or L143K mutation and the CL1 domain comprises a S176E or S176D mutation,
wherein one or both of the CH1-1 and CH1-2 domains comprise a K221E mutation and one or both of the CL1 and CL2 domains comprise a E123K mutation,
wherein the VH1 domain comprises a VH39E mutation and the VL1 domain comprises a VL38K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
wherein one or both of the CH1-1 and CH1-2 domains comprise a K221E mutation and one or both of the CL1 and CL2 domains comprise a E123K mutation,
wherein the VH2 domain comprises a VH39E mutation and the VL2 domain comprises a VL38K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
wherein one or both of the CH1-1 and CH1-2 domains comprise a K221E mutation and one or both of the CL1 and CL2 domains comprise a E123K mutation,
wherein the VH1 domain comprises a VH39K mutation and the VL1 domain comprises a VL38E mutation,
wherein the VH2 domain comprises a VH39E mutation and the VL2 domain comprises a VL38K mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143E or L143D mutation and the CL1 domain comprises a S176R or S176K mutation,
wherein one or both of the CH1-1 and CH1-2 domains comprise a K228D mutation and one or both of the CL1 and CL2 domains comprise a D122K mutation,
wherein the VH1 domain comprises a VH39K mutation and the VL1 domain comprises a VL38E mutation.

In a particular embodiment, the multispecific antibody of the disclosure may comprise:
a) a first light chain (LC1)/heavy chain (HC1) pair comprising
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein the CH1-1 domain comprises a L143R or L143K mutation and the CL1 domain comprises a S176E or S176D mutation,
wherein one or both of the CH1-1 and CH1-2 domains comprise a K228D mutation and one or both of the CL1 and CL2 domains comprise a D122K mutation,
wherein the VH1 domain comprises a VH39E mutation and the VL1 domain comprises a VL38K mutation.

In a particular embodiment, the multispecific antibody of the disclosure may comprise:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and
    (6) a second heterodimerization domain (HD2);
  wherein HD1 and HD2 heterodimerize,
  wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
  wherein one or both of the CH1-1 and CH1-2 domains comprise a K228D mutation and one or both of the CL1 and CL2 domains comprise a D122K mutation,
  wherein the VH2 domain comprises a VH39E mutation and the VL2 domain comprises a VL38K mutation.

In a particular embodiment, the multispecific antibody of the disclosure may comprise:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and
    (6) a second heterodimerization domain (HD2);
  wherein HD1 and HD2 heterodimerize,
  wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation,
  wherein one or both of the CH1-1 and CH1-2 domains comprise a K228D mutation and one or both of the CL1 and CL2 domains comprise a D122K mutation,
  wherein the VH1 domain comprises a VH39K mutation and the VL1 domain comprises a VL38E mutation,
  wherein the VH2 domain comprises a VH39E mutation and the VL2 domain comprises a VL38K mutation.

In a particular embodiment, the multispecific antibody of the disclosure may comprise:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and
    (6) a second heterodimerization domain (HD2);
  wherein HD1 and HD2 heterodimerize,
  wherein the CH1-1 domain comprises a L143E or L143D mutation and the CL1 domain comprises a S176R or S176K mutation,
  wherein one or both of the CH1-1 and CH1-2 domains comprise a K221E and K228D mutation and one or both of the CL1 and CL2 domains comprise a D122K and E123K mutation,
  wherein the VH1 domain comprises a VH39K mutation and the VL1 domain comprises a VL38E mutation.

In a particular embodiment, the multispecific antibody of the disclosure may comprise:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and
    (6) a second heterodimerization domain (HD2);
  wherein HD1 and HD2 heterodimerize,
  wherein the CH1-1 domain comprises a L143R or L143K mutation and the CL1 domain comprises a S176E or S176D mutation,
  wherein the VH1 domain comprises a VH39E mutation and the VL1 domain comprises a VL38K mutation,
  wherein one or both of the CH1-1 and CH1-2 domains comprise a K221E and K228D mutation and one or both of the CL1 and CL2 domains comprise a D122K and E123K mutation.

In a particular embodiment, the multispecific antibody of the disclosure may comprise:
  a) a first light chain (LC1)/heavy chain (HC1) pair comprising
    (1) a first VL region (VL1) paired with first VH region (VH1) to form a first antigen-binding site;
    (2) a first constant heavy chain region 1 (CH1-1) operatively linked to VH1 and a first constant light chain region (CL1) operatively linked to VL1; and
    (3) a first heterodimerization domain (HD1); and
  b) a second light chain (LC2)/heavy chain (HC2) pair comprising
    (4) a second VL region (VL2) paired with a second VH region (VH2) to form a second antigen-binding site;
    (5) a second constant heavy chain region 1 (CH1-2) operatively linked to VH2 and a second constant light chain region (CL2) operatively linked to VL2; and (6) a second heterodimerization domain (HD2);

wherein HD1 and HD2 heterodimerize, wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation, wherein one or both of the CH1-1 and CH1-2 domains comprise a K221E and K228D mutation and one or both of the CL1 and CL2 domains comprise a D122K and E123K mutation, wherein the VH2 domain comprises a VH39E mutation and the VL2 domain comprises a VL38K mutation.

In a particular embodiment, the multispecific antibody of the disclosure may comprise:

a) a first light chain (LC1)/heavy chain (HC1) pair comprising
 (1) a first VL region (VL1) paired with first VH region (VH1) to form a first antigen-binding site;
 (2) a first constant heavy chain region 1 (CH1-1) operatively linked to VH1 and a first constant light chain region (CL1) operatively linked to VL1; and
 (3) a first heterodimerization domain (HD1); and b) a second light chain (LC2)/heavy chain (HC2) pair comprising
 (4) a second VL region (VL2) paired with a second VH region (VH2) to form a second antigen-binding site;
 (5) a second constant heavy chain region 1 (CH1-2) operatively linked to VH2 and a second constant light chain region (CL2) operatively linked to VL2; and
 (6) a second heterodimerization domain (HD2);

wherein HD1 and HD2 heterodimerize, wherein the CH1-1 domain comprises a L143E or L143D mutation and the CH1-2 domain comprises a L143R or L143K mutation and the CL1 domain comprises a S176R or S176K mutation and the CL2 domain comprises a S176E or S176D mutation, wherein one or both of the CH1-1 and CH1-2 domains comprise a K221E and K228D mutation and one or both of the CL1 and CL2 domains comprise a D122K and E123K mutation, wherein the VH1 domain comprises a VH39K mutation and the VL1 domain comprises a VL38E mutation, wherein the VH2 domain comprises a VH39E mutation and the VL2 domain comprises a VL38K mutation.

In a particular embodiment, the multispecific antibody of the disclosure may comprise:

a) a first light chain (LC1)/heavy chain (HC1) pair comprising
 (1) a first VL region (VL1) paired with first VH region (VH1) to form a first antigen-binding site;
 (2) a first constant heavy chain region 1 (CH1-1) operatively linked to VH1 and a first constant light chain region (CL1) operatively linked to VL1; and
 (3) a first heterodimerization domain (HD1); and b) a second light chain (LC2)/heavy chain (HC2) pair comprising
 (4) a second VL region (VL2) paired with a second VH region (VH2) to form a second antigen-binding site;
 (5) a second constant heavy chain region 1 (CH1-2) operatively linked to VH2 and a second constant light chain region (CL2) operatively linked to VL2; and
 (6) a second heterodimerization domain (HD2);

wherein HD1 and HD2 heterodimerize, wherein one or both of the CH1-1 and CH1-2 domains comprise a K221E and K228D mutation and one or both of the CL1 and CL2 domains comprise a D122K and E123K mutation, wherein the VH1 domain comprises a VH39K mutation and the VL1 domain comprises a VL38E mutation.

In a particular embodiment, the multispecific antibody of the disclosure may comprise:

a) a first light chain (LC1)/heavy chain (HC1) pair comprising
 (1) a first VL region (VL1) paired with first VH region (VH1) to form a first antigen-binding site;
 (2) a first constant heavy chain region 1 (CH1-1) operatively linked to VH1 and a first constant light chain region (CL1) operatively linked to VL1; and
 (3) a first heterodimerization domain (HD1); and b) a second light chain (LC2)/heavy chain (HC2) pair comprising
 (4) a second VL region (VL2) paired with a second VH region (VH2) to form a second antigen-binding site;
 (5) a second constant heavy chain region 1 (CH1-2) operatively linked to VH2 and a second constant light chain region (CL2) operatively linked to VL2; and
 (6) a second heterodimerization domain (HD2);

wherein HD1 and HD2 heterodimerize, wherein one or both of the CH1-1 and CH1-2 domains comprise a K221E and K228D mutation and one or both of the CL1 and CL2 domains comprise a D122K and E123K mutation, wherein the VH1 domain comprises a VH39E mutation and the VL1 domain comprises a VL38K mutation, In a particular embodiment, the multispecific antibody of the disclosure may comprise:

a) a first light chain (LC1)/heavy chain (HC1) pair comprising
 (1) a first VL region (VL1) paired with first VH region (VH1) to form a first antigen-binding site;
 (2) a first constant heavy chain region 1 (CH1-1) operatively linked to VH1 and a first constant light chain region (CL1) operatively linked to VL1; and
 (3) a first heterodimerization domain (HD1); and b) a second light chain (LC2)/heavy chain (HC2) pair comprising
 (4) a second VL region (VL2) paired with a second VH region (VH2) to form a second antigen-binding site;
 (5) a second constant heavy chain region 1 (CH1-2) operatively linked to VH2 and a second constant light chain region (CL2) operatively linked to VL2; and
 (6) a second heterodimerization domain (HD2);

wherein HD1 and HD2 heterodimerize, wherein one or both of the CH1-1 and CH1-2 domains comprise a K221E and K228D mutation and one or both of the CL1 and CL2 domains comprise a D122K and E123K mutation, wherein the VH1 domain comprises a VH39K mutation and the VL1 domain comprises a VL38E mutation, wherein the VH2 domain comprises a VH39E mutation and the VL2 domain comprises a VL38K mutation.

VIII. Formulations/Pharmaceutical Compositions

In certain embodiments, a pharmaceutical composition comprising a pharmaceutically acceptable carrier and a therapeutically effective amount of an antigen-binding protein described herein is provided. Some embodiments include pharmaceutical compositions comprising a therapeutically effective amount of any one of the binding proteins as described herein, or a binding protein-drug conjugate, in admixture with a pharmaceutically or physiologically acceptable formulation agent selected for suitability with the mode of administration.

Acceptable formulation materials are typically non-toxic to recipients at the dosages and concentrations employed.

In some embodiments, the pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogensulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides, e.g., sodium or potassium chloride, or mannitol sorbitol), delivery vehicles, diluents, excipients and/or pharmaceutical adjuvants (see, e.g., REMINGTON'S PHARMACEUTICAL SCIENCES (18th Ed., A. R. Gennaro, ed., Mack Publishing Company 1990), and subsequent editions of the same, incorporated herein by reference for any purpose).

In some embodiments the optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

In some embodiments the primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

In some embodiments, the pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

In some embodiments, the formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, multispecific binding proteins that are administered in this fashion can be formulated with or without those carriers customarily used in the compounding of solid dosage forms such as tablets and capsules. For example, a capsule can be designed to release the active portion of the formulation at the point in the gastrointestinal tract when bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of multispecific binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g., films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(−)-3-hydroxybutyric acid. Sustained-release compositions can also include liposomes, which can be prepared by any of several methods known in the art.

In some embodiments, pharmaceutical compositions are to be used for in vivo administration typically must be sterile. This can be accomplished by filtration through sterile filtration membranes. Where the composition is lyophilized, sterilization using this method can be conducted either prior to, or following, lyophilization and reconstitution.

The composition for parenteral administration can be stored in lyophilized form or in a solution. In addition, parenteral compositions generally are placed into a container having a sterile access port, for example, an intravenous solution bag or vial having a stopper that can be pierced by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also encompasses kits for producing a single dose administration unit. The kits can each contain both a first container having a dried multispecific binding protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

In some embodiments, the composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

VIII. Methods of Treatment/Use

Another aspect of the disclosure is a multispecific antibody and/or an antigen-binding protein as described herein for use as a medicament.

In a particular embodiment, a method of treating a disorder in which antigen activity is detrimental, the method comprising administering to a subject in need thereof an effective amount of an antigen-binding protein described herein, is provided.

The binding proteins can be employed in any known assay method, such as competitive binding assays, direct and indirect sandwich assays, and immunoprecipitation assays for the detection and quantitation of one or more target antigens. The binding proteins will bind the one or more target antigens with an affinity that is appropriate for the assay method being employed.

For diagnostic applications, in some embodiments, binding proteins can be labeled with a detectable moiety. The detectable moiety can be any one that is capable of producing, either directly or indirectly, a detectable signal. For example, the detectable moiety can be a radioisotope, such as $^3$H, $^{14}$C, $^{32}$P, $^{35}$S, $^{125}$I, $^{99}$Tc, $^{111}$In, or $^{67}$Ga; a fluorescent or chemiluminescent compound, such as fluorescein isothiocyanate, rhodamine, or luciferin; or an enzyme, such as alkaline phosphatase, β-galactosidase, or horseradish peroxidase.

The binding proteins are also useful for in vivo imaging. A binding protein labeled with a detectable moiety can be administered to an animal, e.g., into the bloodstream, and the presence and location of the labeled antibody in the host assayed. The binding protein can be labeled with any moiety that is detectable in an animal, whether by nuclear magnetic resonance, radiology, or other detection means known in the art.

For clinical or research applications, in some embodiments, binding proteins can be conjugated to a cytotoxic agent. A variety of antibodies coupled to cytotoxic agents (i.e., antibody-drug conjugates) have been used to target cytotoxic payloads to specific tumor cells. Cytotoxic agents and linkers that conjugate the agents to an antibody are known in the art; see, e.g., Parslow, A. C. et al. (2016) Biomedicines 4:14 and Kalim, M. et al. (2017) Drug Des. Devel. Ther. 11:2265-2276.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc.

The containers may be formed from a variety of materials such as glass or plastic. The container holds a composition which is by itself or combined with another composition effective for treating, preventing and/or diagnosing a condition and may have a sterile access port (for example the container may be an intravenous solution bag or a vial having a stopper that can be pierced by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

In some embodiments, a binding protein of the present disclosure is administered to a patient in need thereof for the treatment or prevention of cancer. In some embodiments, the present disclosure relates to a method of preventing and/or treating a proliferative disease or disorder (e.g., cancer). In some embodiments, the method comprises administering to a patient a therapeutically effective amount of at least one of the binding proteins, or pharmaceutical compositions related thereto, described herein.

In some embodiments, the patient is a human.

In some embodiments, the at least one binding protein is administered in combination with one or more anti-cancer therapies (e.g., any anti-cancer therapy known in the art, such as a chemotherapeutic agent or therapy). In some embodiments, the at least one binding protein is administered before the one or more anti-cancer therapies. In some embodiments, the at least one binding protein is administered concurrently with the one or more anti-cancer therapies. In some embodiments, the at least one binding protein is administered after the one or more anti-cancer therapies.

EXAMPLES

Before the present invention is described in detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art. In particular embodiments, the terms used herein are defined as described in "A multilingual glossary of biotechnological terms: (IUPAC Recommendations)," Leuenberger, H. G. W, Nagel, B. and Kolb, H. eds. (1995), Helvetica Chimica Acta, CH-4010 Basel, Switzerland). Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including," as well as other forms, such as "includes" and "included," is not limiting. As used herein, unless otherwise stated, the singular forms "a," "an," and "the" include plural reference. Thus, for example, a reference to "a protein" includes a plurality of protein molecules.

Furthermore, the experiments described herein, unless otherwise indicated, use conventional molecular and cellular biological and immunological techniques within the skill of the art. Such techniques are well known to the skilled worker, and are explained fully in the literature. See, e.g., Ausubel, et al., ed., Current Protocols in Molecular Biology, John Wiley & Sons, Inc., NY, N.Y. (1987-2008), including all supplements, Molecular Cloning: A Laboratory Manual (Fourth Edition) by MR Green and J. Sambrook and Harlow et al., Antibodies: A Laboratory Manual, Chapter 14, Cold Spring Harbor Laboratory, Cold Spring Harbor (2013, 2nd edition).

Several documents are cited throughout the text of this specification. Each of the documents cited herein (including all patents, patent applications, scientific publications, manufacturer's specifications, instructions etc.), whether supra or infra, is hereby incorporated by reference in its entirety. Nothing herein is to be construed as an admission that the invention is not entitled to antedate such disclosure by virtue of prior invention.

In the following, the elements of the present invention will be described. These elements are listed with specific embodiments; however, it should be understood that they may be combined in any manner and in any number to create additional embodiments. The variously described examples and particular embodiments should not be construed to limit the present invention to only the explicitly described embodiments. This description should be understood to support and encompass embodiments which combine the explicitly described embodiments with any number of the disclosed elements. Furthermore, any permutations and combinations of all described elements in this application should be considered disclosed by the description of the present application unless the context indicates otherwise.

Generally, nomenclatures used in connection with cell and tissue culture, molecular biology, immunology, microbiology, genetics and protein and nucleic acid chemistry and hybridization described herein are those well-known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

Fab assembly is driven by VHNL and CH1/CL domain interaction. A variety of multispecific constructs with different architectures containing different Fab interface mutations were generated. The ability of combined mutation pairs within the CH1/CL and VHNL interfaces to direct correct paring was investigated and are described in the examples below.

Example 1: General Expression and Purification Scheme

Expression of Bispecific and Trispecific Molecules

HEK 293-FS cells growing in F17 serum-free suspension culture (Invitrogen) were transfected with the indicated light chain- and heavy chain-encoding plasmids using polyethylenimine transfection reagent. After 7 days of cultivation at 37° C., cells were removed by centrifugation and the supernatant was passed over a 0.22 μm filter to remove particles.

For purification, the antibody was captured on MabSelect SuRe column (Cat. No.: 11-0034-93, GE Healthcare) and eluted with 0.1M Citrate buffer pH 3.0 and directly desalted using a HiPrep 26/10 desalting column (Cat. No.: 17-05087-02, GE Healthcare). After polishing the protein by size exclusion chromatography (SEC) using a Superdex200 26/60 (GE) and a final ultrafiltration concentration step, the protein was used for further characterization.

Analytical Size-Exclusion Chromatography (SEC)

Analytical SEC was performed using a BioSECcurity instrument (PSS Polymer) with a TSKgel SuperSW3000 column (4.6 mm×300 mm) and TSKgel SuperSW HPLC guard column (Tosoh Bioscience) at 25° C. The analysis was run at a flow rate of 0.25 ml/min using 250 mM NaCl, 100 mM Na-phosphate pH 6.7 with detection at 280 nm and 260 nm. Static light scattering was detected at 436 nm. 5 μl of protein sample (at 1 mg/ml) was applied onto the column. Data evaluation was performed using WinGPC software v8.1 (PSS Polymer). For estimation of the molecular weight, the SEC column was calibrated with protein standards in a molecular weight range from 6.5 to 670 kDa.

Analytical Hydrophobic-Interaction Chromatography (HIC)

Analytical HIC was performed using a LC10 HPLC instrument (Shimadzu) with a TSKgel Ether-5PW 10 μm, 2×75 mm (Tosoh Bioscience) at 25° C. The analysis was run at a flow rate of 0.1 ml/min with detection at 280 nm. 5 μg of undiluted protein sample were applied onto the column. Gradient elution was from 0 to 30 min (0% to 100% B) followed by 10 min 100% B and 15 min of re-equilibration. Buffer A was composed of 1.5 M ammonium sulfate, 25 mM sodium phosphate pH7.0. Buffer B was composed of 25 mM sodium phosphate pH 7.0. Data evaluation was performed using LabSolutions software v5.85 (Shimadzu).

Mass Spectrometry (MS)

Protein integrity was analyzed by LC-MS. Protein samples were deglycosylated with 12.5 μg of protein diluted to 0.5 mg/ml in D-PBS buffer treated with 0.5 μl PNGaseF (glycerol free, New England Biolabs) at 37° C. for 15 hours. The LC-MS analysis was performed using a 6540 UHD Accurate-Mass Q-TOF LC/MS instrument (Agilent). Reversed phase (RP) chromatography was done using a Poroshell 300SB-C8 5 μm, 75×0.5 mm (Agilent) with guard column Poroshell 300SB-C8, 5 μm, 2.1×12.5 mm (Agilent) at 180 μL/min. Eluents were LC water, 0.1% formic acid (A) and 90% acetonitrile, 10% LC water, 0.1% formic acid (B). 2 μg of protein was injected onto the column and eluted using a linear gradient from 0% to 100% B in 13 minutes. Data analysis was performed using MassHunter software B.06 (Agilent). Molecular masses were calculated based on the amino acid sequences of the proteins using GPMAW software version 9.13a2 (Lighthouse Data).

Surface Plasmon Resonance (SPR)

Binding of antigens to the antibody constructs was measured using surface plasmon resonance (SPR) with a BIAcore 3000 instrument (GE Healthcare) with HBS-EP buffer (GE Healthcare). The anti-human Fc capture antibody (human antibody capture kit, GE Life Sciences) was immobilized via primary amine groups (11000 RU) on a research grade CM5 chip (GE Life Sciences) using standard procedures. The ligands were captured at a flow rate of 10 μl/min with an adjusted RU value that resulted in maximal analyte binding of 30 RU. The tested antibody constructs were used as analytes and injected at 100 nM concentration for 240 seconds with a dissociation time of 300 seconds at a flow rate of 30 μL/min. Binding kinetics measurements were performed using the captured antibodies with injects of two-fold serial dilutions of the analytes of 3 nM to 100 nM. Chip surfaces were regenerated with 2 min injects of the regeneration buffer provided with the capture kit. Sensorgrams were double referenced with a blank chip surface and HBS-EP buffer blanks. Data analysis was performed using the BIAevaluation software v4.1.

Differential Scanninq Fluorimetry (DSF)

Melting point Tm data was determined using differential scanning fluorimetry (DSF). Samples were diluted in D-PBS buffer (Invitrogen) to a final concentration of 0.2 μg/μl including a 4× concentrated solution of SYPRO-Orange dye (Invitrogen, 5000× stock in DMSO) in D-PBS in white semi-skirt 96-well plates (BIORAD). All measurements were done in duplicate using a MyiQ2 real time PCR instrument (BIORAD). Negative first derivative curves (−d (RFU)/dT) of the melting curves were generated in the iQ5 Software v2.1 (BIORAD). Data were then exported into Excel for Tm determination and graphical display of the data.

Sequences for select tandem Fab antibodies, trispecific CODV antibodies, and bispecific Y-shaped antibodies are recited below in Tables 2, 3, and 4.

TABLE 2

Amino acid sequences for select tandem Fab antibodies.

| ID | Construct Name | Sequence<br>LC-1-Bold & underlined<br>LC-2-Bold & italicized<br>HC-Underlined |
|---|---|---|
| T1 | OX40 × GITR (open) | DIQMTQSPSSLSASVGDRVTITCRASQDISNYLNWYQQKPGKAPKLLIYYT SRLRSGVPSRFSGSGSGTDFTLTISSLQPEDFATYYCQQGHTLPPTFGQG TKVEIKRTVAAPSVFIFPPSDEQLKSGTASVVCLLNNFYPREAKVQWKVD NALQSGNSQESVTEQDSKDSTYSLSSTLTLSKADYEKHKVYACEVTHQG LSSPVTKSFNRGEC\|AIQLTQSPSSLSASVGDRVTITCRASQGISSALAWY QQKPGKAPKLLIYDASSLESGVPSRFSGSGSGTDFTLTISSLQPEDFATYY CQQFNSYPYTFGQGTKLEIKRTVAAPSVFIFPPSDEQLKSGTASVVCLLN NFYPREAKVQWKVDNALQSGNSQESVTEQDSKDSTYSLSSTLTLSKADY EKHKVYACEVTHQGLSSPVTKSFNRGEC\|EVQLVQSGAEVKKPGASVKVS CKASGYTFTDSYMSWVRQAPGQGLEWIGDMYPDNGDSSYNQKFRERVTI TRDTSTSTAYLELSSLRSEDTAVYYCVLAPRWYFSVWGQGTLVTVSSAST KGPSVFPLAPSSKSTSGGTAALGCLVKDYFPEPVTVSWNSGALTSGVHTF PAVLQSSGLYSLSSVVTVPSSSLGTQTYICNVNHKPSNTKVDKKVEPKSCD KTHTAPPAPAPELLGGPSGPPGPGPGGGQVQLVESGGGVVQPGRSLRLS CAASGFTFSSYGMHWVRQAPGKGLEWVAVIWYEGSNKYYADSVKGRFTI SRDNSKNTLYLQMNSLRAEDTAVYYCARGGSMVRGDYYYGMDVWGQGT |

TABLE 2-continued

Amino acid sequences for select tandem Fab antibodies.

| ID | Construct Name | Sequence<br>LC-1-Bold & underlined<br>LC-2-Bold & italicized<br>HC-Underlined |
|---|---|---|
| | | TVTVSSASTKGPSVFPLAPSSKSTSGGTAALGCLVKDYFPEPVTVSWNSG<br>ALTSGVHTFPAVLQSSGLYSLSSVVTVPSSSLGTQTYICNVNHKPSNTKVD<br>KKVEPKSCDKTHTCPPCPAPEAAGGPSVFLFPPKPKDTLMISRTPEVTCVV<br>VDVSHEDPEVKFNWYVDGVEVHNAKTKPREEQYNSTYRVVSVLTVLHQD<br>WLNGKEYKCKVSNKALPAPIEKTISKAKGQPREPQVYTLPPSRDELTKNQV<br>SLTCLVKGFYPSDIAVEWESNGQPENNYKTTPPVLDSDGSFFLYSKLTVDK<br>SRWQQGNVFSCSVMHEALHNHYTQKSLSLSPG (SEQ ID NO: 37) |
| T2 | GITR<br>(CH1:<br>T192E;<br>CK:<br>N137K,<br>S114A) ×<br>OX40<br>(CH1:<br>L143Q,<br>S188V;<br>CK:<br>V133T,<br>S176V)<br>(closed) | <u>EIVMTQSPATLSVSPGERATLSCKASQNVGTNVAWYQQKPGQAPRLLIY</u><br><u>SASYRYSGIPARFSGSGSGTEFTLTISSLQSEDFAVYYCQQYNTDPLTFG</u><br><u>GGTKVEIKRTVAAPAVFIFPPSDEQLKSGTASWCLLKNFYPREAKVQWK</u><br><u>VDNALQSGNSQESVTEQDSKDSTYSLSSTLTLSKADYEKHKVYACEVTH</u><br><u>QGLSSPVTKSFNRGEC</u> | QVTLRESGPALVKPTQTLTLTCTFSGFSLSTSGM<br>GVGWIRQPPGKALEWLAHIWWDDDKYYNPSLKSRLTISKDTSKNQVVLTM<br>TNMDPVDTATYYCARTRRYFPPAYWGQGTLVTVSSASTKGPSVFPLAPSS<br>KSTSGGTAALGCLVKDYFPEPVTVSWNSGALTSGVHTFPAVLQSSGLYSL<br>SSVVEVPSSSLGTQTYICNVNHKPSNTKVDKKVEPKSCDKTHTCPPCPAP<br>ELLGGPSTPPTPSPSGGEVQLVQSGAEVKKPGASVKVSCKASGYTFTDSY<br>MSWVRQAPGQGLEWIGDMYPDNGSSYNQKFRERVTITRDTSTSTAYLE<br>LSSLRSEDTAVYYCVLAPRWYFSVWGQGTLVTVSSASTKGPSVFPLAPSS<br>KSTSGGTAALGCQVKDYFPEPVTVSWNSGALTSGVHTFPAVLQSSGLYSL<br>VSVVTVPSSSLGTQTYICNVNHKPSNTKVDKKVEPKSCDKTHTCPPCPAPE<br>AAGGPSVFLFPPKPKDTLMISRTPEVTCVVVDVSHEDPEVKFNWYVDGVE<br>VHNAKTKPREEQYNSTYRVVSVLTVLHQDWLNGKEYKCKVSNKALPAPIE<br>KTISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEALH<br>NHYTQKSLSLSPG | *EIVLTQSPATLSLSPGERATLSCRASQSVSSYLAWYQ*<br>*QKPGQAPRLLIYDASNRATGIPARFSGSGSGTDFTLTISSLEPEDFAVYYC*<br>*QQSSNWPRTFGQGTKVEIKRTVAAPSVFIFPPSDEQLKSGTASVTCLLNN*<br>*FYPREAKVQWKVDNALQSGNSQESVTEQDSKDSTYSLVSTLTLSKADYE*<br>*KHKVYACEVTHQGLSSPVTKSFNRGEC* (SEQ ID NO: 38) |
| T3 | GITR<br>(Q38K-<br>Q39E)-<br>(CH1:<br>T192E;<br>CK:<br>N137K,<br>S114A) ×<br>OX40<br>(Q38E-<br>Q39K)-<br>(CH1:<br>L143Q,<br>S188V;<br>CK:<br>V133T,<br>S176V)<br>(closed) | <u>EIVMTQSPATLSVSPGERATLSCKASQNVGTNVAWYQKKPGQAPRLLIY</u><br><u>SASYRYSGIPARFSGSGSGTEFTLTISSLQSEDFAVYYCQQYNTDPLTFG</u><br><u>GGTKVEIKRTVAAPAVFIFPPSDEQLKSGTASWCLLKNFYPREAKVQWK</u><br><u>VDNALQSGNSQESVTEQDSKDSTYSLSSTLTLSKADYEKHKVYACEVTH</u><br><u>QGLSSPVTKSFNRGEC</u> | QVTLRESGPALVKPTQTLTLTCTFSGFSLSTSGM<br>GVGWIREPPGKALEWLAHIWWDDDKYYNPSLKSRLTISKDTSKNQVVLTM<br>TNMDPVDTATYYCARTRRYFPPAYWGQGTLVTVSSASTKGPSVFPLAPSS<br>KSTSGGTAALGCLVKDYFPEPVTVSWNSGALTSGVHTFPAVLQSSGLYSL<br>SSVVEVPSSSLGTQTYICNVNHKPSNTKVDKKVEPKSCDKTHTCPPCPAP<br>ELLGGPSTPPTPSPSGGEVQLVQSGAEVKKPGASVKVSCKASGYTFTDSY<br>MSWVRKAPGQGLEWIGDMYPDNGSSYNQKFRERVTITRDTSTSTAYLEL<br>SSLRSEDTAVYYCVLAPRWYFSVWGQGTLVTVSSASTKGPSVFPLAPSSK<br>STSGGTAALGCQVKDYFPEPVTVSWNSGALTSGVHTFPAVLQSSGLYSLV<br>SVVTVPSSSLGTQTYICNVNHKPSNTKVDKKVEPKSCDKTHTCPPCPAPEA<br>AGGPSVFLFPPKPKDTLMISRTPEVTCVVVDVSHEDPEVKFNWYVDGVEV<br>HNAKTKPREEQYNSTYRWSVLTVLHQDWLNGKEYKCKVSNKALPAPIEK<br>TISKAKGQPREPQVYTLPPSRDELTKNQVSLTCLVKGFYPSDIAVEWESNG<br>QPENNYKTTPPVLDSDGSFFLYSKLTVDKSRWQQGNVFSCSVMHEALHN<br>HYTQKSLSLSPG | *DIQMTQSPSSLSASVGDRVTITCRASQDISNYLNWYQE*<br>*KPGKAPKLLIYYTSRLRSGVPSRFSGSGSGTDFTLTISSLQPEDFATYYCQ*<br>*QGHTLPPTFGQGTKVEIKRTVAAPSVFIFPPSDEQLKSGTAVTCLLNNFY*<br>*PREAKVQWKVDNALQSGNSQESVTEQDSKDSTYSLVSTLTLSKADYEKH*<br>*KVYACEVTHQGLSSPVTKSFNRGEC* (SEQ ID NO: 39) |
| T4 | OX40<br>(CH1:<br>L143Q,<br>S188V;<br>CK:<br>V133T,<br>S176V) ×<br>GITR<br>(CH1:<br>T192E;<br>CK:<br>N137K,<br>S114A)<br>(closed) | <u>DIQMTQSPSSLSASVGDRVTITCRASQDISNYLNWYQQKPGKAPKLLIYYT</u><br><u>SRLRSGVPSRFSGSGSGTDFTLTISSLQPEDFATYYCQQGHTLPPTFGQG</u><br><u>TKVEIKRTVAAPSVFIFPPSDEQLKSGTASVTCLLNNFYPREAKVQWKVD</u><br><u>NALQSGNSQESVTEQDSKDSTYSLVSTLTLSKADYEKHKVYACEVTHQG</u><br><u>LSSPVTKSFNRGEC</u> | EVQLVQSGAEVKKPGASVKVSCKASGYTFTDSYMS<br>VWRQAPGQGLEWIGDMYPDNGSSYNQKFRERVTITRDTSTSTAYLELSS<br>LRSEDTAVYYCVLAPRWYFSVWGQGTLVTVSSASTKGPSVFPLAPSSKST<br>SGGTAALGCQVKDYFPEPVTVSWNSGALTSGVHTFPAVLQSSGLYSLSVV<br>VTVPSSSLGTQTYICNVNHKPSNTKVDKKVEPKSCDKTHTCPPCPAPELLG<br>GPSTPPTPSPSGGQVTLRESGPALVKPTQTLTLTCTFSGFSLSTSGMGVG<br>WIRQPPGKALEWLAHIWWDDDKYYNPSLKSRLTISKDTSKNQWLTMTNM<br>DPVDTATYYCARTRRYFPPAYWGQGTLVTVSSASTKGPSVFPLAPSSKST<br>SGGTAALGCLVKDYFPEPVTVSWNSGALTSGVHTFPAVLQSSGLYSLSSV<br>VEVPSSSLGTQTYICNVNHKPSNTKVDKKVEPKSCDKTHTCPPCPAPEAA<br>GGPSVFLFPPKPKDTLMISRTPEVTCVVVDVSHEDPEVKFNWYVDGVEVH<br>NAKTKPREEQYNSTYRVVSVLTVLHQDWLNGKEYKCKVSNKALPAPIEKTI<br>SKAKGQPREPQVYTLPPSRDELTKNQVSLTCLVKGFYPSDIAVEWESNGQ |

TABLE 2-continued

Amino acid sequences for select tandem Fab antibodies.

| ID | Construct Name | Sequence<br>LC-1-Bold & underlined<br>LC-2-Bold & italicized<br>HC-Underlined |
|---|---|---|
| | | PENNYKTTPPVLDSDGSFFLYSKLTVDKSRWQQGNVFSCSVMHEALHNH<br>YTQKSLSLSPG\|*EIVMTQSPATLSVSPGERATLSCKASQNVGTNVAWYQQ<br>KPGQAPRLLIYSASYRYSGIPARFSGSGSGTEFTLTISSLQSEDFAVYYCQ<br>QYNTDPLTFGGGTKVEIKRTVAAPAVFIFPPSDEQLKSGTASVVCLLKNFY<br>PREAKVQWKVDNALQSGNSQESVTEQDSKDSTYSLSSTLTLSKADYEKH<br>KVYACEVTHQGLSSPVTKSFNRGEC* (SEQ ID NO: 40) |
| T5 | OX40<br>(Q38E-<br>Q39K)-<br>(CH1:<br>L143Q;<br>S188V;<br>CK:<br>V133T,<br>S176V) ×<br>GITR<br>(Q38K-<br>Q39E)-<br>CH1:<br>T192E;<br>CK:<br>N137K,<br>S114A)<br>closed) | DIQMTQSPSSLSASVGDRVTITCRASQDISNYLNWYQEKPGKAPKLLIYYT<br>SRLRSGVPSRFSGSGSGTDFTLTISSLQPEDFATYYCQQGHTLPPTFGQG<br>TKVEIKRTVAAPSVFIFPPSDEQLKSGTASVTCLLNNFYPREAKVQWKVD<br>NALQSGNSQESVTEQDSKDSTYSLVSTLTLSKADYEKHKVYACEVTHQG<br>LSSPVTKSFNRGEC\|<u>EVQLVQSGAEVKKPGASVKVSCKASGYTFTDSYMS</u><br><u>WVRKAPGQGLEWIGDMYPDNGDSSYNQKFRERVTITRDTSTSTAYLELSS</u><br><u>LRSEDTAVYYCVLAPRWYFSVWGQGTLVTVSSASTKGPSVFPLAPSSKST</u><br><u>SGGTAALGCQVKDYFPEPVTVSWNSGALTSGVHTFPAVLQSSGLYSLVSV</u><br><u>VTVPSSSLGTQTYICNVNHKPSNTKVDKKVEPKSCDKTHTCPPCPAPELLG</u><br><u>GPSTPPTPSPSGGQVTLRESGPALVKPTQTLTLTCTFSGFSLSTSGMGVG</u><br><u>WIREPPGKALEWLAHIWWDDDKYYNPSLKSRLTISKDTSKNQVVLTMTNM</u><br><u>DPVDTATYYCARTRRYFPFAYWGQGTLVTVSSASTKGPSVFPLAPSSKST</u><br><u>SGGTAALGCLVKDYFPEPVTVSWNSGALTSGVHTFPAVLQSSGLYSLSSV</u><br><u>VEVPSSSLGTQTYICNVNHKPSNTKVDKKVEPKSCDKTHTCPPCPAPEAA</u><br><u>GGPSVFLFPPKPKDTLMISRTPEVTCVVVDVSHEDPEVKFNWYVDGVEVH</u><br><u>NAKTKPREEQYNSTYRVVSVLTVLHQDWLNGKEYKCKVSNKALPAPIEKTI</u><br><u>SKAKGQPREPQVYTLPPSRDELTKNQVSLTCLVKGFYPSDIAVEWESNGQ</u><br><u>PENNYKTTPPVLDSDGSFFLYSKLTVDKSRWQQGNVFSCSVMHEALHNH</u><br><u>YTQKSLSLSPG</u>\|*EIVMTQSPATLSVSPGERATLSCKASQNVGTNVAWYQQ*<br>*KPGQAPRLLIYSASYRYSGIPARFSGSGSGTEFTLTISSLQSEDFAVYYCQ*<br>*QYNTDPLTFGGGTKVEIKRTVAAPAVFIFPPSDEQLKSGTASVVCLLKNFY*<br>*PREAKVQWKVDNALQSGNSQESVTEQDSKDSTYSLSSTLTLSKADYEKH*<br>*KVYACEVTHQGLSSPVTKSFNRGEC* (SEQ ID NO: 41) |
| T6 | GITR<br>(CH1:<br>T192E;<br>CK:<br>N137K,<br>S114A) ×<br>OX40<br>(CH1:<br>L143Q,<br>S188V;<br>CK:<br>V133T,<br>S176V)<br>(open) | EIVMTQSPATLSVSPGERATLSCKASQNVGTNVAWYQQKPGQAPRLLIY<br>SASYRYSGIPARFSGSGSGTEFTLTISSLQSEDFAVYYCQQYNTDPLTFG<br>GGTKVEIKRWAAPAVFIFPPSDEQLKSGTASWCLLKNFYPREAKVQWK<br>VDNALQSGNSQESVTEQDSKDSTYSLSSTLTLSKADYEKHKVYACEVTH<br>QGLSSPVTKSFNRGEC\|<u>QVTLRESGPALVKPTQTLTLTCTFSGFSLSTSGM</u><br><u>GVGWIRQPPGKALEWLAHIWWDDDKYYNPSLKSRLTISKDTSKNQVVLTM</u><br><u>TNMDPVDTATYYCARTRRYFPFAYWGQGTLVTVSSASTKGPSVFPLAPSS</u><br><u>KSTSGGTAALGCLVKDYFPEPVTVSWNSGALTSGVHTFPAVLQSSGLYSL</u><br><u>SSVVEVPSSSLGTQTYICNVNHKPSNTKVDKKVEPKSCDKTHTAPPAPAPE</u><br><u>LLGGPSTPPTPSPSGGEVQLVQSGAEVKKPGASVKVSCKASGYTFTDSYM</u><br><u>SWVRQAPGQGLEWIGDMYPDNGDSSYNQKFRERVTITRDTSTSTAYLELS</u><br><u>SLRSEDTAVYYCVLAPRWYFSVWGQGTLVTVSSASTKGPSVFPLAPSSKS</u><br><u>TSGGTAALGCQVKDYFPEPVTVSWNSGALTSGVHTFPAVLQSSGLYSLVS</u><br><u>VVTVPSSSLGTQTYICNVNHKPSNTKVDKKVEPKSCDKTHTCPPCPAPEAA</u><br><u>GGPSVFLFPPKPKDTLMISRTPEVTCVVVDVSHEDPEVKFNWYVDGVEVH</u><br><u>NAKTKPREEQYNSTYRVVSVLTVLHQDWLNGKEYKCKVSNKALPAPIEKTI</u><br><u>SKAKGQPREPQVYTLPPSRDELTKNQVSLTCLVKGFYPSDIAVEWESNGQ</u><br><u>PENNYKTTPPVLDSDGSFFLYSKLTVDKSRWQQGNVFSCSVMHEALHNH</u><br><u>YTQKSLSLSPG</u>\|*EIVLTQSPATLSLSPGERATLSCRASQSVSSYLAWYQQK*<br>*PGQAPRLLIYDASNRATGIPARFSGSGSGTDFTLTISSLEPEDFAVYYCQQ*<br>*SSNWPRTFGQGTKVEIKRTVAAPSVFIFPPSDEQLKSGTASVTCLLNNFY*<br>*PREAKVQWKVDNALQSGNSQESVTEQDSKDSTYSLVSTLTLSKADYEKH*<br>*KVYACEVTHQGLSSPVTKSFNRGEC* (SEQ ID NO: 42) |
| T7 | GITR<br>(Q38K-<br>Q39E)-<br>(CH1:<br>T192E;<br>CK:<br>N137K,<br>S114A) ×<br>OX40<br>(Q38E-<br>Q39K)-<br>(CH1:<br>L143Q,<br>S188V;<br>CK:<br>V133T,<br>S176V)<br>(open) | EIVMTQSPATLSVSPGERATLSCKASQNVGTNVAWYQKKPGQAPRLLIY<br>SASYRYSGIPARFSGSGSGTEFTLTISSLQSEDFAVYYCQQYNTDPLTFG<br>GGTKVEIKRTVAAPAVFIFPPSDEQLKSGTASWCLLKNFYPREAKVQWK<br>VDNALQSGNSQESVTEQDSKDSTYSLSSTLTLSKADYEKHKVYACEVTH<br>QGLSSPVTKSFNRGEC\|<u>QVTLRESGPALVKPTQTLTLTCTFSGFSLSTSGM</u><br><u>GVGWIREPPGKALEWLAHIWWDDDKYYNPSLKSRLTISKDTSKNQVVLTM</u><br><u>TNMDPVDTATYYCARTRRYFPFAYWGQGTLVTVSSASTKGPSVFPLAPSS</u><br><u>KSTSGGTAALGCLVKDYFPEPVTVSWNSGALTSGVHTFPAVLQSSGLYSL</u><br><u>SSWEVPSSSLGTQTYICNVNHKPSNTKVDKKVEPKSCDKTHTAPPAPAPE</u><br><u>LLGGPSTPPTPSPSGGEVQLVQSGAEVKKPGASVKVSCKASGYTFTDSYM</u><br><u>SWVRKAPGQGLEWIGDMYPDNGDSSYNQKFRERVTITRDTSTSTAYLELS</u><br><u>SLRSEDTAVYYCVLAPRWYFSVWGQGTLVTVSSASTKGPSVFPLAPSSKS</u><br><u>TSGGTAALGCQVKDYFPEPVTVSWNSGALTSGVHTFPAVLQSSGLYSLVS</u><br><u>VVTVPSSSLGTQTYICNVNHKPSNTKVDKKVEPKSCDKTHTCPPCPAPEAA</u><br><u>GGPSVFLFPPKPKDTLMISRTPEVTCVVVDVSHEDPEVKFNWYVDGVEVH</u><br><u>NAKTKPREEQYNSTYRWSVLTVLHQDWLNGKEYKCKVSNKALPAPIEKTI</u><br><u>SKAKGQPREPQVYTLPPSRDELTKNQVSLTCLVKGFYPSDIAVEWESNGQ</u><br><u>PENNYKTTPPVLDSDGSFFLYSKLTVDKSRWQQGNVFSCSVMHEALHNH</u> |

TABLE 2-continued

Amino acid sequences for select tandem Fab antibodies.

| ID | Construct Name | Sequence<br>LC-1-Bold & underlined<br>LC-2-Bold & italicized<br>HC-Underlined |
|---|---|---|
| | | YTQKSLSLSPG\|*DIQMTQSPSSLSASVGDRVTITCRASQDISNYLNWYQEK*<br>*PGKAPKLLIYYTSRLRSGVPSRFSGSGSGTDFTLTISSLQPEDFATYYCQQ*<br>*GHTLPPTFGQGTKVEIKRTVAAPSVFIFPPSDEQLKSGTASVTCLLNNFYP*<br>*REAKVQWKVDNALQSGNSQESVTEQDSKDSTYSLVSTLTLSKADYEKHK*<br>*VYACEVTHQGLSSPVTKSFNRGEC* (SEQ ID NO: 43) |
| T8 | OX40<br>(CH1:<br>L143Q,<br>S188V;<br>CK:<br>V133T,<br>S176V) ×<br>GITR<br>(CH1:<br>T192E;<br>CK:<br>N137K,<br>S114A)<br>(open) | DIQMTQSPSSLSASVGDRVTITCRASQDISNYLNWYQQKPGKAPKLLIYYT<br>SRLRSGVPSRFSGSGSGTDFTLTISSLQPEDFATYYCQQGHTLPPTFGQG<br>TKVEIKRTVAAPSVFIFPPSDEQLKSGTASVTCLLNNFYPREAKVQWKVD<br>NALQSGNSQESVTEQDSKDSTYSLVSTLTLSKADYEKHKVYACEVTHQG<br>LSSPVTKSFNRGEC\|EVQLVQSGAEVKKPGASVKVSCKASGYTFTDSYMS<br>WVRQAPGQGLEWIGDMYPDNGSSYNQKFRERVTITRDTSTSTAYLELSS<br>LRSEDTAVYYCVLAPRWYFSVWGQGTLVTVSSASTKGPSVFPLAPSSKST<br>SGGTAALGCQVKDYFPEPVTVSWNSGALTSGVHTFPAVLQSSGLYSLVSV<br>VTVPSSSLGTQTYICNVNHKPSNTKVDKKVEPKSCDKTHTAPPAPAPELLG<br>GPSTPPTPSPSGGQVTLRESGPALVKPTQTLTLTCTFSGFSLSTSGMGVG<br>WIRQPPGKALEWLAHIWWDDDKYYNPSLKSRLTISKDTSKNQWLTMTNM<br>DPVDTATYYCARTRRYFPPFAYWGQGTLVTVSSASTKGPSVFPLAPSSKST<br>SGGTAALGCLVKDYFPEPVTVSWNSGALTSGVHTFPAVLQSSGLYSLSSV<br>VEVPSSSLGTQTYICNVNHKPSNTKVDKKVEPKSCDKTHTCPPCPAPEAA<br>GGPSVFLFPPKPKDTLMISRTPEVTCVVVDVSHEDPEVKFNWYVDGVEVH<br>NAKTKPREEQYNSTYRVVSVLTVLHQDWLNGKEYKCKVSNKALPAPIEKTI<br>SKAKGQPREPQVYTLPPSRDELTKNQVSLTCLVKGFYPSDIAVEWESNGQ<br>PENNYKTTPPVLDSDGSFFLYSKLTVDKSRWQQGNVFSCSVMHEALHNH<br>YTQKSLSLSPG\|*EIVMTQSPATLSVSPGERATLSCKASQNVGTNVAWYQQ*<br>*KPGQAPRLLIYSASYRYSGIPARFSGSGSGTEFTLTISSLQSEDFAVYYCQ*<br>*QYNTDPLTFGGGTKVEIKRTVAAPAVFIFPPSDEQLKSGTASVVCLLKNFY*<br>*PREAKVQWKVDNALQSGNSQESVTEQDSKDSTYSLSSTLTLSKADYEKH*<br>*KVYACEVTHQGLSSPVTKSFNRGEC* (SEQ ID NO: 44) |
| T9 | OX40<br>(Q38E-<br>Q39K) -<br>(CH1:<br>L143Q,<br>S188V;<br>CK:<br>V133T,<br>S176V) ×<br>GITR<br>(Q38K-<br>Q39E) -<br>(CH1:<br>T192E;<br>CK:<br>N137K,<br>S114A)<br>(open) | DIQMTQSPSSLSASVGDRVTITCRASQDISNYLNWYQEKPGKAPKLLIYYT<br>SRLRSGVPSRFSGSGSGTDFTLTISSLQPEDFATYYCQQGHTLPPTFGQG<br>TKVEIKRTVAAPSVFIFPPSDEQLKSGTASVTCLLNNFYPREAKVQWKVD<br>NALQSGNSQESVTEQDSKDSTYSLVSTLTLSKADYEKHKVYACEVTHQG<br>LSSPVTKSFNRGEC\|EVQLVQSGAEVKKPGASVKVSCKASGYTFTDSYMS<br>VWRKAPGQGLEWIGDMYPDNGSSYNQKFRERVTITRDTSTSTAYLELSS<br>LRSEDTAVYYCVLAPRWYFSVWGQGTLVTVSSASTKGPSVFPLAPSSKST<br>SGGTAALGCQVKDYFPEPVTVSWNSGALTSGVHTFPAVLQSSGLYSLVSV<br>VTVPSSSLGTQTYICNVNHKPSNTKVDKKVEPKSCDKTHTAPPAPAPELLG<br>GPSTPPTPSPSGGQVTLRESGPALVKPTQTLTLTCTFSGFSLSTSGMGVG<br>WIREPPGKALEWLAHIWWDDDKYYNPSLKSRLTISKDTSKNQVVLTMTNM<br>DPVDTATYYCARTRRYFPPFAYWGQGTLVTVSSASTKGPSVFPLAPSSKST<br>SGGTAALGCLVKDYFPEPVTVSWNSGALTSGVHTFPAVLQSSGLYSLSSV<br>VEVPSSSLGTQTYICNVNHKPSNTKVDKKVEPKSCDKTHTCPPCPAPEAA<br>GGPSVFLFPPKPKDTLMISRTPEVTCVVVDVSHEDPEVKFNWYVDGVEVH<br>NAKTKPREEQYNSTYRWSVLTVLHQDWLNGKEYKCKVSNKALPAPIEKTI<br>SKAKGQPREPQVYTLPPSRDELTKNQVSLTCLVKGFYPSDIAVEWESNGQ<br>PENNYKTTPPVLDSDGSFFLYSKLTVDKSRWQQGNVFSCSVMHEALHNH<br>YTQKSLSLSPG\|*EIVMTQSPATLSVSPGERATLSCKASQNVGTNVAWYQK*<br>*KPGQAPRLLIYSASYRYSGIPARFSGSGSGTEFTLTISSLQSEDFAVYYCQ*<br>*QYNTDPLTFGGGTKVEIKRTVAAPAVFIFPPSDEQLKSGTASVVCLLKNFY*<br>*PREAKVQWKVDNALQSGNSQESVTEQDSKDSTYSLSSTLTLSKADYEKH*<br>*KVYACEVTHQGLSSPVTKSFNRGEC* (SEQ ID NO: 45) |
| T10 | PD1 ×<br>OX40<br>(open) | EIVLTQSPATLSLSPGERATLSCRASQSVSSYLAWYQQKPGQAPRLLIYD<br>ASNRATGIPARFSGSGSGTDFTLTISSLEPEDFAVYYCQQSSNWPRTFGQ<br>GTKVEIKRTVAAPSVFIFPPSDEQLKSGTASVVCLLNNFYPREAKVQWKV<br>DNALQSGNSQESVTEQDSKDSTYSLSSTLTLSKADYEKHKVYACEVTHQ<br>GLSSPVTKSFNRGEC\|*DIQMTQSPSSLSASVGDRVTITCRASQDISNYLNW*<br>*YQQKPGKAPKLLIYYTSRLRSGVPSRFSGSGSGTDFTLTISSLQPEDFATY*<br>*YCQQGHTLPPTFGQGTKVEIKRTVAAPSVFIFPPSDEQLKSGTASVVCLL*<br>*NNFYPREAKVQWKVDNALQSGNSQESVTEQDSKDSTYSLSSTLTLSKAD*<br>*YEKHKVYACEVTHQGLSSPVTKSFNRGEC*\|QVQLVESGGGVVQPGRSLR<br>LDCKASGITFSNSGMHWVRQAPGKGLEWVAVIWYDGSKRYYADSVKGRF<br>TISRDNSKNTLFLQMNSLRAEDTAVYYCATNDDYWGQGTLVTVSSASTKG<br>PSVFPLAPSSKSTSGGTAALGCLVKDYFPEPVTVSWNSGALTSGVHTFPA<br>VLQSSGLYSLSSWTVPSSSLGTQTYICNVNHKPSNTKVDKKVEPKSCDKT<br>HTAPPAPAPELLGGPSGPPGPGPGGGEVQLVQSGAEVKKPGASVKVSCK<br>ASGYTFTDSYMSWVRQAPGQGLEWIGDMYPDNGSSYNQKFRERVTITR<br>DTSTSTAYLELSSLRSEDTAVYYCVLAPRWYFSVWGQGTLVTVSSASTKG<br>PSVFPLAPSSKSTSGGTAALGCLVKDYFPEPVTVSWNSGALTSGVHTFPA<br>VLQSSGLYSLSVVTVPSSSLGTQTYICNVNHKPSNTKVDKKVEPKSCDKT<br>HTCPPCPAPEAAGGPSVFLFPPKPKDTLMISRTPEVTCVVVDVSHEDPEVK |

TABLE 2-continued

Amino acid sequences for select tandem Fab antibodies.

| ID | Construct Name | Sequence<br>LC-1-Bold & underlined<br>LC-2-Bold & italicized<br>HC-Underlined |
|---|---|---|
| | | FNWYVDGVEVHNAKTKPREEQYNSTYRVVSVLTVLHQDWLNGKEYKCKV<br>SNKALPAPIEKTISKAKGQPREPQVYTLPPSRDELTKNQVSLTCLVKGFYPS<br>DIAVEWESNGQPENNYKTTPPVLDSDGSFFLYSKLTVDKSRWQQGNVFS<br>CSVMHEALHNHYTQKSLSLSPG (SEQ ID NO: 46) |
| T11 | OX40<br>(CH1:<br>T192E;<br>CK:<br>N137K,<br>S114A) ×<br>GITR<br>(CH1:<br>L143Q,<br>S188V<br>CK:<br>V133T,<br>S176V)<br>(closed) | DIQMTQSPSSLSASVGDRVTITCRASQDISNYLNWYQEKPGKAPKLLIYYT<br>SRLRSGVPSRFSGSGSGTDFTLTISSLQPEDFATYYCQQGHTLPPTFGQG<br>TKVEIKRTVAAPSVFIFPPSDEQLKSGTASVTCLLNNFYPREAKVQWKVD<br>NALQSGNSQESVTEQDSKDSTYSLVSTLTLSKADYEKHKVYACEVTHQG<br>LSSPVTKSFNRGEC | <u>EVQLVQSGAEVKKPGASVKVSCKASGYTFTDSYMS</u><br><u>WVRKAPGQGLEWIGDMYPDNGDSSYNQKFRERVTITRDTSTSTAYLELSS</u><br><u>LRSEDTAVYYCVLAPRWYFSVWGQGTLVTVSSASTKGPSVFPLAPSSKST</u><br><u>SGGTAALGCQVKDYFPEPVTVSWNSGALTSGVHTFPAVLQSSGLYSLVSV</u><br><u>VTVPSSSLGTQTYICNVNHKPSNTKVDKKVEPKSCDKTHTAPPAPAPELLG</u><br><u>GPSTPPTPSPSGGQVQLVESGGGVVQPGRSLRLSCAASGFTFSSYGMH</u><br><u>WVREAPGKGLEWVAVIWYEGSNKYYADSVKGRFTISRDNSKNTLYLQMN</u><br><u>SLRAEDTAVYYCARGGSMVRGDYYYGMDVWGQGTTVTVSSASTKGPSV</u><br><u>FPLAPSSKSTSGGTAALGCLVKDYFPEPVTVSWNSGALTSGVHTFPAVLQ</u><br><u>SSGLYSLSSVVEVPSSSLGTQTYICNVNHKPSNTKVDKKVEPKSCDKTHTC</u><br><u>PPCPAPEAAGGPSVFLFPPKPKDTLMISRTPEVTCVVVDVSHEDPEVKFN</u><br><u>WYVDGVEVHNAKTKPREEQYNSTYRVVSVLTVLHQDWLNGKEYKCKVSN</u><br><u>KALPAPIEKTISKAKGQPREPQVYTLPPSRDELTKNQVSLTCLVKGFYPSDI</u><br><u>AVEWESNGQPENNYKTTPPVLDSDGSFFLYSKLTVDKSRWQQGNVFSCS</u><br><u>VMHEALHNHYTQKSLSLSPG</u> | *AIQLTQSPSSLSASVGDRVTITCRASQGISS*<br>*ALAWYQKKPGKAPKLLIYDASSLESGVPSRFSGSGSGTDFTLTISSLQPE*<br>*DFATYYCQQFNSYPYTFGQGTKLEIKRTVAAPAVFIFPPSDEQLKSGTAS*<br>*VVCLLKNFYPREAKVQWKVDNALQSGNSQESVTEQDSKDSTYSLSSTLT*<br>*LSKADYEKHKVYACEVTHQGLSSPVTKSFNRGEC* (SEQ ID NO: 47) |
| T12 | PD-L1<br>(Q38K-<br>Q39E) -<br>(CH1:<br>T192E;<br>CK:<br>N137K,<br>S114A) ×<br>CD40<br>(Q38E-<br>Q39K) -<br>(CH1:<br>L143Q,<br>S188V;<br>CK:<br>V133T,<br>S176V)<br>(closed) | DIQMTQSPSSLSASVGDRVTITCRASQDVSTAVAWYQQKPGKAPKLLIYS<br>ASFLYSGVPSRFSGSGSGTDFTLTISSLQPEDFATYYCQQYLYHPATFGQ<br>GTKVEIKRTVAAPSVFIFPPSDEQLKSGTASVTCLLNNFYPREAKVQWKV<br>DNALQSGNSQESVTEQDSKDSTYSLVSTLTLSKADYEKHKVYACEVTHQ<br>GLSSPVTKSFNRGEC | <u>EVQLVESGGGLVQPGGSLRLSCAASGFTFSDSWI</u><br><u>HWVRQAPGKGLEWVAWISPYGGSTYYADSVKGRFTISADTSKNTAYLQM</u><br><u>NSLRAEDTAVYYCARRHWPGGFDYWGQGTLVTVSSASTKGPSVFPLAPS</u><br><u>SKSTSGGTAALGCQVKDYFPEPVTVSWNSGALTSGVHTFPAVLQSSGLYS</u><br><u>LVSVVTVPSSSLGTQTYICNVNHKPSNTKVDKKVEPKSCDKTHTCPPCPAP</u><br><u>ELLGGPSTPPTPSPSGGQVQLVQSGAEVKKPGASVKVSCKASGYTFTGYY</u><br><u>MHWVRQAPGQGLEWMGWINPDSGGTNYAQKFQGRVTMTRDTSISTAYM</u><br><u>ELNRLRSDDTAVYYCARDQPLGYCTNGVCSYFDYWGQGTLVTVSSASTK</u><br><u>GPSVFPLAPSSKSTSGGTAALGCLVKDYFPEPVTVSWNSGALTSGVHTFP</u><br><u>AVLQSSGLYSLSSWEVPSSSLGTQTYICNVNHKPSNTKVDKKVEPKSCDK</u><br><u>THTCPPCPAPEAAGGPSVFLFPPKPKDTLMISRTPEVTCVVVDVSHEDPEV</u><br><u>KFNWYVDGVEVHNAKTKPREEQYNSTYRVVSVLTVLHQDWLNGKEYKCK</u><br><u>VSNKALPAPIEKTISKAKGQPREPQVYTLPPSRDELTKNQVSLTCLVKGFYP</u><br><u>SDIAVEWESNGQPENNYKTTPPVLDSDGSFFLYSKLTVDKSRWQQGNVFS</u><br><u>CSVMHEALHNHYTQKSLSLSPG</u> | *DIQMTQSPSSVSASVGDRVTITCRASQ*<br>*GIYSWLAWYQQKPGKAPNLLIYTASTLQSGVPSRFSGSGSGTDFTLTISS*<br>*LQPEDFATYYCQQANIFPLTFGGGTKVEIKRTVAAPAVFIFPPSDEQLKSG*<br>*TASVVCLLKNFYPREAKVQWKVDNALQSGNSQESVTEQDSKDSTYSLSS*<br>*TLTLSKADYEKHKVYACEVTHQGLSSPVTKSFNRGEC* (SEQ ID NO: 48) |
| T13 | CD40<br>(CH1:<br>L143Q,<br>S188V;<br>CK:<br>V133T,<br>S176V) ×<br>PD-L1<br>(CH1:<br>T192E;<br>CK:<br>N137K,<br>S114A)<br>(closed) | DIQMTQSPSSVSASVGDRVTITCRASQGIYSWLAWYQQKPGKAPNLLIYT<br>ASTLQSGVPSRFSGSGSGTDFTLTISSLQPEDFATYYCQQANIFPLTFGG<br>GTKVEIKRTVAAPAVFIFPPSDEQLKSGTASVVCLLKNFYPREAKVQWKV<br>DNALQSGNSQESVTEQDSKDSTYSLSSTLTLSKADYEKHKVYACEVTHQ<br>GLSSPVTKSFNRGEC | <u>QVQLVQSGAEVKKPGASVKVSCKASGYTFTGYYM</u><br><u>HWVRQAPGQGLEWMGWINPDSGGTNYAQKFQGRVTMTRDTSISTAYME</u><br><u>LNRLRSDDTAVYYCARDQPLGYCTNGVCSYFDYWGQGTLVTVSSASTKG</u><br><u>PSVFPLAPSSKSTSGGTAALGCLVKDYFPEPVTVSWNSGALTSGVHTFPA</u><br><u>VLQSSGLYSLSSVVEVPSSSLGTQTYICNVNHKPSNTKVDKKVEPKSCDKT</u><br><u>HTCPPCPAPELLGGPSTPPTPSPSGGEVQLVESGGGLVQPGGSLRLSCAA</u><br><u>SGFTFSDSWIHWVRQAPGKGLEWVAWISPYGGSTYYADSVKGRFTISADT</u><br><u>SKNTAYLQMNSLRAEDTAVYYCARRHWPGGFDYWGQGTLVTVSSASTKG</u><br><u>PSVFPLAPSSKSTSGGTAALGCQVKDYFPEPVTVSWNSGALTSGVHTFPA</u><br><u>VLQSSGLYSLVSVVTVPSSSLGTQTYICNVNHKPSNTKVDKKVEPKSCDKT</u><br><u>HTCPPCPAPEAAGGPSVFLFPPKPKDTLMISRTPEVTCVVVDVSHEDPEVK</u><br><u>FNWYVDGVEVHNAKTKPREEQYNSTYRVVSVLTVLHQDWLNGKEYKCKV</u><br><u>SNKALPAPIEKTISKAKGQPREPQVYTLPPSRDELTKNQVSLTCLVKGFYPS</u><br><u>DIAVEWESNGQPENNYKTTPPVLDSDGSFFLYSKLTVDKSRWQQGNVFS</u><br><u>CSVMHEALHNHYTQKSLSLSPG</u> | *DIQMTQSPSSLSASVGDRVTITCRASQD*<br>*VSTAVAWYQQKPGKAPKLLIYSASFLYSGVPSRFSGSGSGTDFTLTISSL* |

TABLE 2-continued

Amino acid sequences for select tandem Fab antibodies.

| Construct ID | Name | Sequence<br>LC-1-Bold & underlined<br>LC-2-Bold & italicized<br>HC-Underlined |
|---|---|---|
| | | *QPEDFATYYCQQYLYHPATFGQGTKVEIKRTVAAPSVFIFPPSDEQLKSG*<br>*TASVTCLLNNFYPREAKVQWKVDNALQSGNSQESVTEQDSKDSTYSLVS*<br>*TLTLSKADYEKHKVYACEVTHQGLSSPVTKSFNRGEC* (SEQ ID NO: 49) |
| T14 | CD40<br>(Q38E-<br>Q39K)-<br>(CH1:<br>L143Q,<br>S188V;<br>CK:<br>V133T,<br>S176V) ×<br>PD-L1<br>(Q38K-<br>Q39E)-<br>(CH1:<br>T192E;<br>CK:<br>N137K,<br>S114A)<br>(closed) | DIQMTQSPSSLSASVGDRVTITCRASQDVSTAVAWYQEKPGKAPKLLIYS<br>ASFLYSGVPSRFSGSGSGTDFTLTISSLQPEDFATYYCQQYLYHPATFGQ<br>GTKVEIKRTVAAPSVFIFPPSDEQLKSGTASVTCLLNNFYPREAKVQWKV<br>DNALQSGNSQESVTEQDSKDSTYSLVSTLTLSKADYEKHKVYACEVTHQ<br>GLSSPVTKSFNRGEC│<u>EVQLVESGGGLVQPGGSLRLSCAASGFTFSDSWI</u><br><u>HWVRKAPGKGLEWVAWISPYGGSTYYADSVKGRFTISADTSKNTAYLQM</u><br><u>NSLRAEDTAVYYCARRHWPGGFDYWGQGTLVTVSSASTKGPSVFPLAPS</u><br><u>SKSTSGGTAALGCQVKDYFPEPVTVSWNSGALTSGVHTFPAVLQSSGLYS</u><br><u>LVSVVTPSSSLGTQTYICNVNHKPSNTKVDKKVEPKSCDKTHTCPPCPAP</u><br><u>ELLGGPSTPPTPSPSGGQVQLVQSGAEVKKPGASVKVSCKASGYTFTGYY</u><br><u>MHWVREAPGQGLEWMGWINPDSGGTNYAQKFQGRVTMTRDTSISTAYM</u><br><u>ELNRLRSDDTAVYYCARDQPLGYCTNGVCSYFDYWGQGTLVTVSSASTK</u><br><u>GPSVFPLAPSSKSTSGGTAALGCLVKDYFPEPVTVSWNSGALTSGVHTFP</u><br><u>AVLQSSGLYSLSSVVEVPSSSLGTQTYICNVNHKPSNTKVDKKVEPKSCDK</u><br><u>THTCPPCPAPEAAGGPSVFLFPPKPKDTLMISRTPEVTCVVVDVSHEDPEV</u><br><u>KFNWYVDGVEVHNAKTKPREEQYNSTYRVVSVLTVLHQDWLNGKEYKCK</u><br><u>VSNKALPAPIEKTISKAGQPREPQVYTLPPSRDELTKNQVSLTCLVKGFYP</u><br><u>SDIAVEWESNGQPENNYKTTPPVLDSDGSFFLYSKLTVDKSRWQQGNVFS</u><br><u>CSVMHEALHNHYTQKSLSLSPG</u>│*DIQMTQSPSSVSASVGDRVTITCRASQ*<br>*GIYSWLAWYQKKPGKAPNLLIYTASTLQSGVPSRFSGSGSGTDFTLTISS*<br>*LQPEDFATYYCQQANIFPLTFGGGTKVEIKRTVAAPAVFIFPPSDEQLKSG*<br>*TASVVCLLKNFYPREAKVQWKVDNALQSGNSQESVTEQDSKDSTYSLSS*<br>*TLTLSKADYEKHKVYACEVTHQGLSSPVTKSFNRGEC* (SEQ ID NO: 50) |
| T15 | OX40<br>(CH1:<br>T192E;<br>CK:<br>N137K,<br>S114A) ×<br>PD1<br>(CH1:<br>L143Q,<br>S188V;<br>CK:<br>V133T,<br>S176V)<br>(open) | DIQMTQSPSSLSASVGDRVTITCRASQDISNYLNWYQEKPGKAPKLLIYYT<br>SRLRSGVPSRFSGSGSGTDFTLTISSLQPEDFATYYCQQGHTLPPTFGQG<br>TKVEIKRTVAAPSVFIFPPSDEQLKSGTASVTCLLNNFYPREAKVQWKV<br>NALQSGNSQESVTEQDSKDSTYSLVSTLTLSKADYEKHKVYACEVTHQG<br>LSSPVTKSFNRGEC│<u>EVQLVQSGAEVKKPGASVKVSCKASGYTFTDSYMS</u><br><u>WVRKAPGQGLEWIGDMYPDNGDSSYNQKFRERVTITRDTSTSTAYLELSS</u><br><u>LRSEDTAVYYCVLAPRWYFSVWGQGTLVTVSSASTKGPSVFPLAPSSKST</u><br><u>SGGTAALGCQVKDYFPEPVTVSWNSGALTSGVHTFPAVLQSSGLYSLVSV</u><br><u>VTVPSSSLGTQTYICNVNHKPSNTKVDKKVEPKSCDKTHTCPPCPAPELLG</u><br><u>GPSTPPTPSPSGGQVQLVESGGGVVQPGRSLRLDCKASGITFSNSGMHW</u><br><u>VREAPGKGLEWVAVIWYDGSKRYYADSVKGRFTISRDNSKNTLFLQMNSL</u><br><u>RAEDTAVYYCATNDDYWGQGTLVTVSSASTKGPSVFPLAPSSKSTSGGTA</u><br><u>ALGCLVKDYFPEPVTVSWNSGALTSGVHTFPAVLQSSGLYSLSSVVEVPS</u><br><u>SSLGTQTYICNVNHKPSNTKVDKKVEPKSCDKTHTCPPCPAPEAAGGPSV</u><br><u>FLFPPKPKDTLMISRTPEVTCVVVDVSHEDPEVKFNWYVDGVEVHNAKTK</u><br><u>PREEQYNSTYRVVSVLTVLHQDWLNGKEYKCKVSNKALPAPIEKTISKAKG</u><br><u>QPREPQVYTLPPSRDELTKNQVSLTCLVKGFYPSDIAVEWESNGQPENNY</u><br><u>KTTPPVLDSDGSFFLYSKLTVDKSRWQQGNVFSCSVMHEALHNHYTQKSL</u><br><u>SLSPG</u>│*EIVLTQSPATLSLSPGERATLSCRASQSVSSYLAWYQKKPGQAP*<br>*RLLIYDASNRATGIPARFSGSGSGTDFTLTISSLEPEDFAVYYCQQSSNWP*<br>*RTFGQGTKVEIKRTVAAPAVFIFPPSDEQLKSGTASVVCLLKNFYPREAK*<br>*VQWKVDNALQSGNSQESVTEQDSKDSTYSLSSTLTLSKADYEKHKVYAC*<br>*EVTHQGLSSPVTKSFNRGEC* (SEQ ID NO: 51) |
| T16 | PD-L1<br>(Q38K-<br>Q39E)-<br>(CH1:<br>T192E;<br>CK:<br>N137K,<br>S114A) ×<br>CD40<br>(Q38E-<br>Q39K)-<br>(CH1:<br>L143Q,<br>S188V;<br>CK:<br>V133T,<br>S176V)<br>(open) | DIQMTQSPSSLSASVGDRVTITCRASQDVSTAVAWYQQKPGKAPKLLIYS<br>ASFLYSGVPSRFSGSGSGTDFTLTISSLQPEDFATYYCQQYLYHPATFGQ<br>GTKVEIKRTVAAPSVFIFPPSDEQLKSGTASVTCLLIMNFYPREAKVQWKV<br>DNALQSGNSQESVTEQDSKDSTYSLVSTLTLSKADYEKHKVYACEVTHQ<br>GLSSPVTKSFNRGEC│<u>EVQLVESGGGLVQPGGSLRLSCAASGFTFSDSWI</u><br><u>HWVRQAPGKGLEWVAWISPYGGSTYYADSVKGRFTISADTSKNTAYLQM</u><br><u>NSLRAEDTAVYYCARRHWPGGFDYWGQGTLVTVSSASTKGPSVFPLAPS</u><br><u>SKSTSGGTAALGCQVKDYFPEPVTVSWNSGALTSGVHTFPAVLQSSGLYS</u><br><u>LVSWTVPSSSLGTQTYICNVNHKPSNTKVDKKVEPKSCDKTHTAPPAPAP</u><br><u>ELLGGPSTPPTPSPSGGQVQLVQSGAEVKKPGASVKVSCKASGYTFTGYY</u><br><u>MHWVRQAPGQGLEWMGWINPDSGGTNYAQKFQGRVTMTRDTSISTAYM</u><br><u>ELNRLSDDTAVYYCARDQPLGYCTNGVCSYFDYWGQGTLVTVSSASTK</u><br><u>GPSVFPLAPSSKSTSGGTAALGCLVKDYFPEPVTVSWNSGALTSGVHTFP</u><br><u>AVLQSSGLYSLSSWEVPSSSLGTQTYICNVNHKPSNTKVDKKVEPKSCDK</u><br><u>THTCPPCPAPEAAGGPSVFLFPPKPKDTLMISRTPEVTCVVVDVSHEDPEV</u><br><u>KFNWYVDGVEVHNAKTKPREEQYNSTYRVVSVLTVLHQDWLNGKEYKCK</u><br><u>VSNKALPAPIEKTISKAKGQPREPQVYTLPPSRDELTKNQVSLTCLVKGFYP</u><br><u>SDIAVEWESNGQPENNYKTTPPVLDSDGSFFLYSKLTVDKSRWQQGNVFS</u><br><u>CSVMHEALHNHYTQKSLSLSPG</u>│*DIQMTQSPSSVSASVGDRVTITCRASQ*<br>*GIYSWLAWYQQKPGKAPNLLIYTASTLQSGVPSRFSGSGSGTDFTLTISS*<br>*LQPEDFATYYCQQANIFPLTFGGGTKVEIKRTVAAPAVFIFPPSDEQLKSG* |

TABLE 2-continued

Amino acid sequences for select tandem Fab antibodies.

| ID | Construct Name | Sequence<br>LC-1-Bold & underlined<br>LC-2-Bold & italicized<br>HC-Underlined |
|---|---|---|
| | | *TASVVCLLKNFYPREAKVQWKVDNALQSGNSQESVTEQDSKDSTYSLSS*<br>*TLTLSKADYEKHKVYACEVTHQGLSSPVTKSFNRGEC* (SEQ ID NO: 52) |
| T17 | CD40<br>(CH1:<br>L143Q,<br>S188V;<br>CK:<br>V133T,<br>S176V) x<br>PD-L1<br>(CH1:<br>T192E;<br>CK:<br>N137K,<br>S114A)<br>(open) | DIQMTQSPSSVSASVGDRVTITCRASQGIYSWLAWYQQKPGKAPNLLIYT<br>ASTLQSGVPSRFSGSGSGTDFTLTISSLQPEDFATYYCQQANIFPLTFGG<br>GTKVEIKRTVAAPAVFIFPPSDEQLKSGTASVVCLLKNFYPREAKVQWKV<br>DNALQSGNSQESVTEQDSKDSTYSLSSTLTLSKADYEKHKVYACEVTHQ<br>GLSSPVTKSFNRGEC\|<u>QVQLVQSGAEVKKPGASVKVSCKASGYTFTGYYM</u><br><u>HWVRQAPGQGLEWMGWINPDSGGTNYAQKFQGRVTMTRDTSISTAYME</u><br><u>LNRLRSDDTAVYYCARDQPLGYCTNGVCSYFDYWGQGTLVTVSSASTKG</u><br><u>PSVFPLAPSSKSTSGGTAALGCLVKDYFPEPVTVSWNSGALTSGVHTFPA</u><br><u>VLQSSGLYSLSSVVEVPSSSLGTQTYICNVNHKPSNTKVDKKVEPKSCDKT</u><br><u>HTAPPAPAPELLGGPSTPPTPSPSGGEVQLVESGGGLVQPGGSLRLSCAA</u><br><u>SGFTFSDSWIHWVRQAPGKGLEVWAWISPYGGSTYYADSVKGRFTISADT</u><br><u>SKNTAYLQMNSLRAEDTAVYYCARRHWPGGFDYWGQGTLVTVSSASTKG</u><br><u>PSVFPLAPSSKSTSGGTAALGCQVKDYFPEPVTVSWNSGALTSGVHTFPA</u><br><u>VLQSSGLYSLVSVVTVPSSSLGTQTYICNVNHKPSNTKVDKKVEPKSCDKT</u><br><u>HTCPPCPAPEAAGGPSVFLFPPKPKDTLMISRTPEVTCVVVDVSHEDPEVK</u><br><u>FNWYVDGVEVHNAKTKPREEQYNSTYRVVSVLTVLHQDWLNGKEYKCKV</u><br><u>SNKALPAPIEKTISKAKGQPREPQVYTLPPSRDELTKNQVSLTCLVKGFYPS</u><br><u>DIAVEWESNGQPENNYKTTPPVLDSDGSFFLYSKLTVDKSRWQQGNVFS</u><br><u>CSVMHEALHNHYTQKSLSLSPG</u>\|*DIQMTQSPSSLSASVGDRVTITCRASQD*<br>*VSTAVAWYQQKPGKAPKLLIYSASFLYSGVPSRFSGSGSGTDFTLTISSL*<br>*QPEDFATYYCQQYLYHPATFGQGTKVEIKRTVAAPSVFIFPPSDEQLKSG*<br>*TASVTCLLNNFYPREAKVQWKVDNALQSGNSQESVTEQDSKDSTYSLVS*<br>*TLTLSKADYEKHKVYACEVTHQGLSSPVTKSFNRGEC* (SEQ ID NO: 53) |
| T18 | PD-L1<br>(Q38E-<br>Q39K)-<br>(CH1:<br>L143Q,<br>S188V;<br>CK:<br>V133T,<br>S176V) x<br>OX40<br>(Q38K-<br>Q39E)-<br>(CH1:<br>T192E;<br>CK:<br>N137K,<br>S114A)<br>(open) | DIQMTQSPSSLSASVGDRVTITCRASQDVSTAVAWYQEKPGKAPKLLIYS<br>ASFLYSGVPSRFSGSGSGTDFTLTISSLQPEDFATYYCQQYLYHPATFGQ<br>GTKVEIKRTVAAPSVFIFPPSDEQLKSGTASVTCLLNNFYPREAKVQWKV<br>DNALQSGNSQESVTEQDSKDSTYSLVSTLTLSKADYEKHKVYACEVTHQ<br>GLSSPVTKSFNRGEC\|<u>EVQLVESGGGLVQPGGSLRLSCAASGFTFSDSWI</u><br><u>HWVRKAPGKGLEWVAWISPYGGSTYYADSVKGRFTISADTSKNTAYLQM</u><br><u>NSLRAEDTAVYYCARRHWPGGFDYWGQGTLVTVSSASTKGPSVFPLAPS</u><br><u>SKSTSGGTAALGCQVKDYFPEPVTVSWNSGALTSGVHTFPAVLQSSGLYS</u><br><u>LVSVVTVPSSSLGTQTYICNVNHKPSNTKVDKKVEPKSCDKTHTAPPAPAP</u><br><u>ELLGGPSTPPTPSPSGGQVQLVQSGAEVKKPGASVKVSCKASGYTFTGYY</u><br><u>MHWVREAPGQGLEWMGWINPDSGGTNYAQKFQGRVTMTRDTSISTAYM</u><br><u>ELNRLRSDDTAVYYCARDQPLGYCTNGVCSYFDYWGQGTLVTVSSASTK</u><br><u>GPSVFPLAPSSKSTSGGTAALGCLVKDYFPEPVTVSWNSGALTSGVHTFP</u><br><u>AVLQSSGLYSLSSVVEVPSSSLGTQTYICNVNHKPSNTKVDKKVEPKSCDK</u><br><u>THTCPPCPAPEAAGGPSVFLFPPKPKDTLMISRTPEVTCVVVDVSHEDPEV</u><br><u>KFNWYVDGVEVHNAKTKPREEQYNSTYRVVSVLTVLHQDWLNGKEYKCK</u><br><u>VSNKALPAPIEKTISKAKGQPREPQVYTLPPSRDELTKNQVSLTCLVKGFYP</u><br><u>SDIAVEWESNGQPENNYKTTPPVLDSDGSFFLYSKLTVDKSRWQQGNVFS</u><br><u>CSVMHEALHNHYTQKSLSLSPG</u>\|*DIQMTQSPSSVSASVGDRVTITCRASQ*<br>*GIYSWLAWYQKKPGKAPNLLIYTASTLQSGVPSRFSGSGSGTDFTLTISS*<br>*LQPEDFATYYCQQANIFPLTFGGGTKVEIKRTVAAPAVFIFPPSDEQLKSG*<br>*TASVVCLLKNFYPREAKVQWKVDNALQSGNSQESVTEQDSKDSTYSLSS*<br>*TLTLSKADYEKHKVYACEVTHQGLSSPVTKSFNRGEC* (SEQ ID NO: 54) |
| T19 | PD1<br>(CH1:<br>T192E;<br>CK:<br>N137K,<br>S114A) x<br>OX40<br>(CH1:<br>L143Q,<br>S188V;<br>CK:<br>V133T,<br>S176V)<br>(closed) | EIVLTQSPATLSLSPGERATLSCRASQSVSSYLAWYQQKPGQAPRLLIYD<br>ASNRATGIPARFSGSGSGTDFTLTISSLEPEDFAVYYCQQSSNWPRTFGQ<br>GTKVEIKRTVAAPAVFIFPPSDEQLKSGTASVVCLLKNFYPREAKVQWKV<br>DNALQSGNSQESVTEQDSKDSTYSLSSTLTLSKADYEKHKVYACEVTHQ<br>GLSSPVTKSFNRGEC\|<u>QVQLVESGGGVVQPGRSLRLDCKASGITFSNSGM</u><br><u>HWVRQAPGKGLEWVAVIWYDGSKRYYADSVKGRFTISRDNSKNTLFLQM</u><br><u>NSLRAEDTAVYYCATNDDYWGQGTLVTVSSASTKGPSVFPLAPSSKSTSG</u><br><u>GTAALGCLVKDYFPEPVTVSWNSGALTSGVHTFPAVLQSSGLYSLSSVVE</u><br><u>VPSSSLGTQTYICNVNHKPSNTKVDKKVEPKSCDKTHTCPPCPAPELLGG</u><br><u>PSTPPTPSPSGGEVQLVQSGAEVKKPGASVKVSCKASGYTFTDSYMSWV</u><br><u>RQAPGQGLEWIGDMYPDNGDSSYNQKFRERVTITRDTSTSTAYLELSSLR</u><br><u>SEDTAVYYCVLAPRWYFSVWGQGTLVTVSSASTKGPSVFPLAPSSKSTSG</u><br><u>GTAALGCQVKDYFPEPVTVSWNSGALTSGVHTFPAVLQSSGLYSLVSVVT</u><br><u>VPSSSLGTQTYICNVNHKPSNTKVDKKVEPKSCDKTHTCPPCPAPEAAGG</u><br><u>PSVFLFPPKPKDTLMISRTPEVTCVVVDVSHEDPEVKFNWYVDGVEVHNA</u><br><u>KTKPREEQYNSTYRVVSVLTVLHQDWLNGKEYKCKVSNKALPAPIEKTISK</u><br><u>AKGQPREPQVYTLPPSRDELTKNQVSLTCLVKGFYPSDIAVEWESNGQPE</u><br><u>NNYKTTPPVLDSDGSFFLYSKLTVDKSRWQQGNVFSCSVMHEALHNHYT</u><br><u>QKSLSLSPG</u>\|*DIQMTQSPSSLSASVGDRVTITCRASQDISNYLNWYQQKPG*<br>*KAPKLLIYYTSRLRSGVPSRFSGSGSGTDFTLTISSLQPEDFATYYCQQGH*<br>*TLPPTFGQGTKVEIKRTVAAPSVFIFPPSDEQLKSGTASVTCLLNNFYPRE* |

TABLE 2-continued

Amino acid sequences for select tandem Fab antibodies.

| ID | Construct Name | Sequence LC-1-Bold & underlined LC-2-Bold & italicized HC-Underlined |
|---|---|---|
| | | *AKVQWKVDNALQSGNSQESVTEQDSKDSTYSLVSTLTLSKADYEKHKVY ACEVTHQGLSSPVTKSFNRGEC* (SEQ ID NO: 55) |
| T20 | PD1 (Q38K-Q39E)-(CH1: T192E; CK: N137K, S114A) × OX40 (Q38E-Q39K)-(CH1: L143Q, S188V; CK: V133T, S176V) (closed) | EIVLTQSPATLSLSPGERATLSCRASQSVSSYLAWYQKKPGQAPRLLIYD ASNRATGIPARFSGSGSGTDFTLTISSLEPEDFAVYYCQQSSNWPRTFGQ GTKVEIKRTVAAPAVFIFPPSDEQLKSGTASVVCLLKNFYPREAKVQWKV DNALQSGNSQESVTEQDSKDSTYSLSSTLTLSKADYEKHKVYACEVTHQ GLSSPVTKSFNRGEC | QVQLVESGGGVVQPGRSLRLDCKASGITFSNSGM HWVREAPGKGLEWVAVIWYDGSKRYYADSVKGRFTISRDNSKNTLFLQM NSLRAEDTAVYYCATNDDYWGQGTLVTVSSASTKGPSVFPLAPSSKSTSG GTAALGCLVKDYFPEPVTVSWNSGALTSGVHTFPAVLQSSGLYSLSSVVE VPSSSLGTQTYICNVNHKPSNTKVDKKVEPKSCDKTHTCPPCPAPELLGG PSTPPTPSPSGGEVQLVQSGAEVKKPGASVKVSCKASGYTFTDSYMSWV RKAPGQGLEWIGDMYPDNGDSSYNQKFRERVTITRDTSTSTAYLELSSLR SEDTAVYYCVLAPRWYFSVWGQGTLVTVSSASTKGPSVFPLAPSSKSTSG GTAALGCQVKDYFPEPVTVSWNSGALTSGVHTFPAVLQSSGLYSLVSVVT VPSSSLGTQTYICNVNHKPSNTKVDKKVEPKSCDKTHTCPPCPAPEAAGG PSVFLFPPKPKDTLMISRTPEVTCVVVDVSHEDPEVKFNWYVDGVEHNA KTKPREEQYNSTYRVVSVLTVLHQDWLNGKEYKCKVSNKALPAPIEKTISK AKGQPREPQVYTLPPSRDELTKNQVSLTCLVKGFYPSDIAVEWESNGQPE NNYKTTPPVLDSDGSFFLYSKLTVDKSRWQQGNVFSCSVMHEALHNHYT QKSLSLSPG | *DIQMTQSPSSLSASVGDRVTITCRASQDISNYLNWYQEKPG KAPKLLIYYTSRLRSGVPSRFSGSGSGTDFTLTISSLQPEDFATYYCQQGH TLPPTFGQGTKVEIKRTVAAPSVFIFPPSDEQLKSGTASVTCLLNNFYPRE AKVQWKVDNALQSGNSQESVTEQDSKDSTYSLVSTLTLSKADYEKHKVY ACEVTHQGLSSPVTKSFNRGEC* (SEQ ID NO: 56) |
| T21 | OX40 (CH1: L143Q, S188V; CK: V133T, S176V) × PD1 (CH1: T192E; CK: N137K, S114A) (closed) | DIQMTQSPSSLSASVGDRVTITCRASQDISNYLNWYQQKPGKAPKLLIYYT SRLRSGVPSRFSGSGSGTDFTLTISSLQPEDFATYYCQQGHTLPPTFGQG TKVEIKRTVAAPSVFIFPPSDEQLKSGTASVTCLLNNFYPREAKVQWKVD NALQSGNSQESVTEQDSKDSTYSLVSTLTLSKADYEKHKVYACEVTHQG LSSPVTKSFNRGEC | EVQLVQSGAEVKKPGASVKVSCKASGYTFTDSYMS WVRQAPGQGLEWIGDMYPDNGDSSYNQKFRERVTITRDTSTSTAYLELSS LRSEDTAVYYCVLAPRWYFSVWGQGTLVTVSSASTKGPSVFPLAPSSKST SGGTAALGCQVKDYFPEPVTVSWNSGALTSGVHTFPAVLQSSGLYSLVSV VTVPSSSLGTQTYICNVNHKPSNTKVDKKVEPKSCDKTHTCPPCPAPELLG GPSTPPTPSPSGGQVQLVESGGGVVQPGRSLRLDCKASGITFSNSGMHW VRQAPGKGLEWVAVIWYDGSKRYYADSVKGRFTISRDNSKNTLFLQMNSL RAEDTAVYYCATNDDYWGQGTLVTVSSASTKGPSVFPLAPSSKSTSGGTA ALGCLVKDYFPEPVTVSWNSGALTSGVHTFPAVLQSSGLYSLSSVVEVPS SSLGTQTYICNVNHKPSNTKVDKKVEPKSCDKTHTCPPCPAPEAAGGPSV FLFPPKPKDTLMISRTPEVTCVVVDVSHEDPEVKFNWYVDGVEVHNAKTK PREEQYNSTYRWSVLTVLHQDWLNGKEYKCKVSNKALPAPIEKTISKAKG QPREPQVYTLPPSRDELTKNQVSLTCLVKGFYPSDIAVEWESNGQPENNY KTTPPVLDSDGSFFLYSKLTVDKSRWQQGNVFSCSVMHEALHNHYTQKSL SLSPG | *EIVLTQSPATLSLSPGERATLSCRASQSVSSYLAWYQQKPGQAP RLLIYDASNRATGIPARFSGSGSGTDFTLTISSLEPEDFAVYYCQQSSNWP RTFGQGTKVEIKRTVAAPAVFIFPPSDEQLKSGTASVVCLLKNFYPREAK VQWKVDNALQSGNSQESVTEQDSKDSTYSLSSTLTLSKADYEKHKVYAC EVTHQGLSSPVTKSFNRGEC* (SEQ ID NO: 57) |
| T22 | CD40 (Q38E-Q39K)-(CH1: L143Q, S188V; CK: V133T, S176V) × PD-L1 (Q38K-Q39E)-(CH1: T192E; CK: N137K, S114A) (closed) | DIQMTQSPSSVSASVGDRVTITCRASQGIYSWLAWYQKKPGKAPNLLIYT ASTLQSGVPSRFSGSGSGTDFTLTISSLQPEDFATYYCQQANIFPLTFGG GTKVEIKRTVAAPAVFIFPPSDEQLKSGTASVVCLLKNFYPREAKVQWKV DNALQSGNSQESVTEQDSKDSTYSLSSTLTLSKADYEKHKVYACEVTHQ GLSSPVTKSFNRGEC | QVQLVQSGAEVKKPGASVKVSCKASGYTFTGYYM HWVREAPGQGLEWMGWINPDSGGTNYAQKFQGRVTMTRDTSISTAYME LNRLRSDDTAVYYCARDQPLGYCTNGVCSYFDYWGQGTLVTVSSASTKG PSVFPLAPSSKSTSGGTAALGCLVKDYFPEPVTVSWNSGALTSGVHTFPA VLQSSGLYSLSSVVEVPSSSLGTQTYICNVNHKPSNTKVDKKVEPKSCDKT HTCPPCPAPELLGGPSTPPTPSPSGGEVQLVESGGGLVQPGGSLRLSCAA SGFTFSDSWIHWVRKAPGKGLEWVAWISPYGGSTYYADSVKGRFTISADT SKNTAYLQMNSLRAEDTAVYYCARRHWPGGFDYWGQGTLVTVSSASTKG PSVFPLAPSSKSTSGGTAALGCQVKDYFPEPVTVSWNSGALTSGVHTFPA VLQSSGLYSLVSVVTVPSSSLGTQTYICNVNHKPSNTKVDKKVEPKSCDKT HTCPPCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKCKV SNKALPAPIEKTISKAKGQPREPQVYTLPPSRDELTKNQVSLTCLVKGFYPS DIAVEWESNGQPENNYKTTPPVLDSDGSFFLYSKLTVDKSRWQQGNVFS CSVMHEALHNHYTQKSLSLSPG | *DIQMTQSPSSLSASVGDRVTITCRASQD VSTAVAWYQEKPGKAPKLLIYSASFLYSGVPSRFSGSGSGTDFTLTISSL QPEDFATYYCQQYLYHPATFGQGTKVEIKRTVAAPSVFIFPPSDEQLKSG* |

TABLE 2-continued

Amino acid sequences for select tandem Fab antibodies.

Sequence
LC-1-Bold & underlined
LC-2-Bold & italicized
HC-Underlined

| ID | Construct Name | Sequence |
|---|---|---|
| | | *TASVTCLLNNFYPREAKVQWKVDNALQSGNSQESVTEQDSKDSTYSLVS TLTLSKADYEKHKVYACEVTHQGLSSPVTKSFNRGEC* (SEQ ID NO: 58) |
| T23 | PD1 (CH1: T192E; CK: N137K, S114A) × OX40 (CH1: L143Q, S188V; CK: V133T, S176V) (open) | EIVLTQSPATLSLSPGERATLSCRASQSVSSYLAWYQQKPGQAPRLLIYD ASNRATGIPARFSGSGSGTDFTLTISSLEPEDFAVYYCQQSSNWPRTFGQ GTKVEIKRTVAAPAVFIFPPSDEQLKSGTASVVCLLKNFYPREAKVQWKV DNALQSGNSQESVTEQDSKDSTYSLSSTLTLSKADYEKHKVYACEVTHQ GLSSPVTKSFNRGEC\|<u>QVQLVESGGGVVQPGRSLRLDCKASGITFSNSGM HWVRQAPGKGLEWVAVIWYDGSKRYYADSVKGRFTISRDNSKNTLFLQM NSLRAEDTAVYYCATNDDYWGQGTLVTVSSASTKGPSVFPLAPSSKSTSG GTAALGCLVKDYFPEPVTVSWNSGALTSGVHTFPAVLQSSGLYSLSSVVE VPSSSLGTQTYICNVNHKPSNTKVDKKVEPKSCDKTHTAPPAPAPELLGGP STPPTPSPSGGEVQLVQSGAEVKKPGASVKVSCKASGYTFTDSYMSWVR QAPGQGLEWIGDMYPDNGDSSYNQKFRERVTITRDTSTSTAYLELSSLRS EDTAVYYCVLAPRWYFSVWGQGTLVTVSSASTKGPSVFPLAPSSKSTSGG TAALGCQVKDYFPEPVTVSWNSGALTSGVHTFPAVLQSSGLYSLVSVVTV PSSSLGTQTYICNVNHKPSNTKVDKKVEPKSCDKTHTCPPCPAPEAAGGP SVFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISKA KGQPREPQVYTLPPSRDELTKNQVSLTCLVKGFYPSDIAVEWESNGQPEN NYKTTPPVLDSDGSFFLYSKLTVDKSRWQQGNVFSCSVMHEALHNHYTQ KSLSLSPG</u>\|*DIQMTQSPSSLSASVGDRVTITCRASQDISNYLNWYQQKPGK APKLLIYYTSRLRSGVPSRFSGSGSGTDFTLTISSLQPEDFATYYCQQGHT LPPTFGQGTKVEIKRTVAAPSVFIFPPSDEQLKSGTASVTCLLNNFYPREA KVQWKVDNALQSGNSQESVTEQDSKDSTYSLVSTLTLSKADYEKHKVYA CEVTHQGLSSPVTKSFNRGEC* (SEQ ID NO: 59) |
| T24 | PD1 (Q38K-Q39E)-(CH1: T192E; CK: N137K, S114A) × OX40 (Q38E-Q39K)-(CH1: L143Q, S188V; CK: V133T, S176V) (open) | EIVLTQSPATLSLSPGERATLSCRASQSVSSYLAWYKKPGQAPRLLIYD ASNRATGIPARFSGSGSGTDFTLTISSLEPEDFAVYYCQQSSNWPRTFGQ GTKVEIKRTVAAPAVFIFPPSDEQLKSGTASVVCLLKNFYPREAKVQWKV DNALQSGNSQESVTEQDSKDSTYSLSSTLTLSKADYEKHKVYACEVTHQ GLSSPVTKSFNRGEC\|<u>QVQLVESGGGVVQPGRSLRLDCKASGITFSNSGM HWVREAPGKGLEWVAVIWYDGSKRYYADSVKGRFTISRDNSKNTLFLQM NSLRAEDTAVYYCATNDDYWGQGTLVTVSSASTKGPSVFPLAPSSKSTSG GTAALGCLVKDYFPEPVTVSWNSGALTSGVHTFPAVLQSSGLYSLSSVVE VPSSSLGTQTYICNVNHKPSNTKVDKKVEPKSCDKTHTAPPAPAPELLGGP STPPTPSPSGGEVQLVQSGAEVKKPGASVKVSCKASGYTFTDSYMSWVR KAPGQGLEWIGDMYPDNGDSSYNQKFRERVTITRDTSTSTAYLELSSLRS EDTAVYYCVLAPRWYFSVWGQGTLVTVSSASTKGPSVFPLAPSSKSTSGG TAALGCQVKDYFPEPVTVSWNSGALTSGVHTFPAVLQSSGLYSLVSVVTV PSSSLGTQTYICNVNHKPSNTKVDKKVEPKSCDKTHTCPPCPAPEAAGGP SVFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISKA KGQPREPQVYTLPPSRDELTKNQVSLTCLVKGFYPSDIAVEWESNGQPEN NYKTTPPVLDSDGSFFLYSKLTVDKSRWQQGNVFSCSVMHEALHNHYTQ KSLSLSPG</u>\|*DIQMTQSPSSLSASVGDRVTITCRASQDISNYLNWYQEKPGK APKLLIYYTSRLRSGVPSRFSGSGSGTDFTLTISSLQPEDFATYYCQQGHT LPPTFGQGTKVEIKRTVAAPSVFIFPPSDEQLKSGTASVTCLLNNFYPREA KVQWKVDNALQSGNSQESVTEQDSKDSTYSLVSTLTLSKADYEKHKVYA CEVTHQGLSSPVTKSFNRGEC* (SEQ ID NO: 60) |
| T25 | OX40 (CH1: L143Q, S188V; CK: V133T, S176V) × PD1 (CH1: T192E; CK: N137K, S114A) (open) | DIQMTQSPSSLSASVGDRVTITCRASQDISNYLNWYQQKPGKAPKLLIYYT SRLRSGVPSRFSGSGSGTDFTLTISSLQPEDFATYYCQQGHTLPPTFGQG TKVEIKRTVAAPSVFIFPPSDEQLKSGTASVTCLLNNFYPREAKVQWKVD NALQSGNSQESVTEQDSKDSTYSLVSTLTLSKADYEKHKVYACEVTHQG LSSPVTKSFNRGEC\|<u>EVQLVQSGAEVKKPGASVKVSCKASGYTFTDSYMS WVRQAPGQGLEWIGDMYPDNGDSSYNQKFRERVTITRDTSTSTAYLELSS LRSEDTAVYYCVLAPRWYFSVWGQGTLVTVSSASTKGPSVFPLAPSSKST SGGTAALGCQVKDYFPEPVTVSWNSGALTSGVHTFPAVLQSSGLYSLVSV VTVPSSSLGTQTYICNVNHKPSNTKVDKKVEPKSCDKTHTAPPAPAPELLG GPSTPPTPSPSGGQVQLVESGGGVVQPGRSLRLDCKASGITFSNSGMHW VRQAPGKGLEWVAVIWYDGSKRYYADSVKGRFTISRDNSKNTLFLQMNSL RAEDTAVYYCATNDDYWGQGTLVTVSSASTKGPSVFPLAPSSKSTSGGTA ALGCLVKDYFPEPVTVSWNSGALTSGVHTFPAVLQSSGLYSLSSVVEVPS SSLGTQTYICNVNHKPSNTKVDKKVEPKSCDKTHTCPPCPAPEAAGGPSV FLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKG QPREPQVYTLPPSRDELTKNQVSLTCLVKGFYPSDIAVEWESNGQPENNY KTTPPVLDSDGSFFLYSKLTVDKSRWQQGNVFSCSVMHEALHNHYTQKSL SLSPG</u>\|*EIVLTQSPATLSLSPGERATLSCRASQSVSSYLAWYQQKPGQAP RLLIYDASNRATGIPARFSGSGSGTDFTLTISSLEPEDFAVYYCQQSSNWP RTFGQGTKVEIKRTVAAPAVFIFPPSDEQLKSGTASVVCLLKNFYPREAK* |

TABLE 2-continued

Amino acid sequences for select tandem Fab antibodies.

| ID | Construct Name | Sequence LC-1-Bold & underlined LC-2-Bold & italicized HC-Underlined |
|---|---|---|
| | | *VQWKVDNALQSGNSQESVTEQDSKDSTYSLSSTLTLSKADYEKHKVYAC EVTHQGLSSPVTKSFNRGEC* (SEQ ID NO: 61) |
| T26 | CD40 (Q38E-Q39K)-(CH1: L143Q, S188V; CK: V133T, S176V) × PD-L1 (Q38K-Q39E)-(CH1: T192E; CK: N137K, S114A) (open) | DIQMTQSPSSVSASVGDRVTITCRASQGIYSWLAWYQKKPGKAPNLLIYT ASTLQSGVPSRFSGSGSGTDFTLTISSLQPEDFATYYCQQANIFPLTFGG GTKVEIKRTVAAPAVFIFPPSDEQLKSGTASVVCLLKNFYPREAKVQWKV DNALQSGNSQESVTEQDSKDSTYSLSSTLTLSKADYEKHKVYACEVTHQ GLSSPVTKSFNRGEC\|<u>QVQLVQSGAEVKKPGASVKVSCKASGYTFTGYYM HVWREAPGQGLEWMGWINPDSGGTNYAQKFQGRVTMTRDTSISTAYME LNRLRSDDTAVYYCARDQPLGYCTNGVCSYFDYWGQGTLVTVSSASTKG PSVFPLAPSSKSTSGGTAALGCLVKDYFPEPVTVSWNSGALTSGVHTFPA VLQSSGLYSLSSWEVPSSSLGTQTYICNVNHKPSNTKVDKKVEPKSCDKT HTAPPAPAPELLGGPSTPPTPSPSGGEVQLVESGGGLVQPGGSLRLSCAA SGFTFSDSWIHWVRKAPGKGLEWVAWISPYGGSTYYADSVKGRFTISADT SKNTAYLQMNSLRAEDTAVYYCARRHWPGGFDYWGQGTLVTVSSASTKG PSVFPLAPSSKSTSGGTAALGCQVKDYFPEPVTVSWNSGALTSGVHTFPA VLQSSGLYSLVSWTVPSSSLGTQTYICNVNHKPSNTKVDKKVEPKSCDKT HTCPPCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKCKV SNKALPAPIEKTISKAKGQPREPQVYTLPPSRDELTKNQVSLTCLVKGFYPS DIAVEWESNGQPENNYKTTPPVLDSDGSFFLYSKLTVDKSRWQQGNVFS CSVMHEALHNHYTQKSLSLSPG</u>\|*DIQMTQSPSSLSASVGDRVTITCRASQD VSTAVAWYQEKPGKAPKLLIYSASFLYSGVPSRFSGSGSGTDFTLTISSL QPEDFATYYCQQYLYHPATFGQGTKVEIKRTVAAPSVFIFPPSDEQLKSG TASVTCLLNNFYPREAKVQWKVDNALQSGNSQESVTEQDSKDSTYSLVS TLTLSKADYEKHKVYACEVTHQGLSSPVTKSFNRGEC* (SEQ ID NO: 62) |

TABLE 3

Amino acid sequences for trispecific CODV antibodies.

| ID | LC1 Sequence | HC1 Sequence | HC2 Sequence | LC2 Sequence |
|---|---|---|---|---|
| C1 Wild type | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKGGGG SGGGGSDIQMT QSPSSLSASVG DRVTITCRASQD ISNYLNWYQQK PGKAPKLLIYYT SRLRSGVPSRF SGSGSGTDFTL TISSLQPEDFAT YYCQQGHTLPP TFGQGTKVEIKG GGGSGGGGSR TVAAPSVFIFPP SDEQLKSGTAS VVCLLNNFYPR EAKVQWKVDNA LQSGNSQESVT EQDSKDSTYSL SSTLTLSKADYE KHKVYACEVTH QGLSSPVTKSF NRGEC | EVQLVQSGAEVKKP LSPGERATLSC GASVKVSCKASGYT FTDSYMSWVRQAP GQGLEWIGDMYPD NGDSSYNQKFRER VTITRDTSTSTAYLE LSSLRSEDTAVYYC VLAPRWYFSVWGQ GTLVTVSSQVLVE SGGGVVQPGRSLR LDCKASGITFSNSG MHWVRQAPGKGLE WVAVIWYDGSKRY YADSVKGRFTISRD NSKNTLFLQMNSLR AEDTAVYYCATNDD YWGQGTLVTVSSA STKGPSVFPLAPSS KSTSGGTAALGCLV KDYFPEPVTVSWNS GALTSGVHTFPAVL QSSGLYSLSSVVTV PSSSLGTQTYICNV NHKPSNTKVDKKVE PKSCDKTHTCPPCP APEAAGGPSVFLFP PKPKDTLMISRTPEV TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG | QVQLVESGGGVVQP GRSLRLSCAASGFTF SSYGMHWVRQAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPEA AGGPSVFLFPPKPKD TLMISRTPEVTCVVVD VSHEDPEVKFNWYVD GVEVHNAKTKPREEQ YNSTYRVVSVLTVLHQ DWLNGKEYKCKVSNK ALPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQQ KPGKAPKLLIYDA SSLESGVPSRFSG SGSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |

TABLE 3-continued

Amino acid sequences for trispecific CODV antibodies.

| ID | LC1 Sequence | HC1 Sequence | HC2 Sequence | LC2 Sequence |
|---|---|---|---|---|
| | | QPENNYKTTPPVLD SDGSFFLYSKLTVD KSRWQQGNVFSCS VMHEALHNHYTQKS LSLSPG | | |
| C2 CH1/Ck mutations | EIVLT TABLE 3-continued Amino acid sequences for trispecific CODV antibodies.

| ID | LC1 Sequence | HC1 Sequence | HC2 Sequence | LC2 Sequence |
|---|---|---|---|---|
| | STLTLSKADYEK HKVYACEVTHQ GLSSPVTKSFN RGEC | TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG QPENNYKTTPPVLD SDGSFFLYSKLTVD KSRWQQGNVFSCS VMHEALHNHYTQKS LSLSPG | FFLVSKLTVDKSRWQ QGNVFSCSVMHEALH NRFTQKSLSLSPG | |
| C4 Disulfide | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGCG TKVEIKGGGGS GGGGSDIQMTQ SPSSLSASVGD RVTITCRASQDI SNYLNWYQQKP GKAPKLLIYYTS RLRSGVPSRFS GSGSGTDFTLTI SSLQPEDFATY YCQQGHTLPPT FGCGTKVEIKG GGGSGGGGSR TVAAPSVFIFPP SDEQLKSGTAS VVCLLNNFYPR EAKVQWKVDNA LQSGNSQESVT EQDSKDSTYSL SSTLTLSKADYE KHKVYACEVTH QGLSSPVTKSF NRGEC | EVQLVQSGAEVKKP GASVKVSCKASGYT FTDSYMSWVRQAP GQCLEWIGDMYPD NGDSSYNQKFRER VTITRDTSTSTAYLE LSSLRSEDTAVYYC VLAPRWYFSVWGQ GTLVTVSSQVLVE SGGGVVQPGRSLR LDCKASGITFSNSG MHWVRQAPGKCLE WVAVIWYDGSKRY YADSVKGRFTISRD NSKNTLFLQMNSLR AEDTAVYYCATNDD YWGQGTLVTVSSA STKGPSVFPLAPSS KSTSGGTAALGCLV KDYFPEPVTVSWNS GALTSGVHTFPAVL QSSGLYSLSSVVTV PSSSLGTQTYICNV NHKPSNTKVDKKVE PKSCDKTHTCPPCP APEAAGGPSVFLFP PKPKDTLMISRTPEV TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG QPENNYKTTPPVLD SDGSFFLYSKLTVD KSRWQQGNVFSCS VMHEALHNHYTQKS LSLSPG | QVQLVESGGGVVQP GRSLRLSCAASGFTF SSYGMHWVRQAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPEA AGGPSVFLFPPKPKD TLMISRTPEVTCVVVD VSHEDPEVKFNWYVD GVEVHNAKTKPREEQ YNSTYRVVSVLTVLHQ DWLNGKEYKCKVSNK ALPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQQ KPGKAPKLLIYDA SSLESGVPSRFSG SGSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |
| C5 CH1/Ck + ds | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGCG TKVEIKGGGGS GGGGSDIQMTQ SPSSLSASVGD RVTITCRASQDI SNYLNWYQQKP GKAPKLLIYYTS RLRSGVPSRFS GSGSGTDFTLTI SSLQPEDFATY | EVQLVQSGAEVKKP GASVKVSCKASGYT FTDSYMSWVRQAP GQCLEWIGDMYPD NGDSSYNQKFRER VTITRDTSTSTAYLE LSSLRSEDTAVYYC VLAPRWYFSVWGQ GTLVTVSSQVLVE SGGGVVQPGRSLR LDCKASGITFSNSG MHWVRQAPGKCLE WVAVIWYDGSKRY YADSVKGRFTISRD NSKNTLFLQMNSLR AEDTAVYYCATNDD YWGQGTLVTVSSA STKGPSVFPLAPSS | QVQLVESGGGVVQP GRSLRLSCAASGFTF SSYGMHWVRQAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPEA AGGPSVFLFPPKPKD TLMISRTPEVTCVVVD | AIQLTQSPSSLSA SVGDRVTITCRAS QGISSALAWYQQ KPGKAPKLLIYDA SSLESGVPSRFSG SGSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |

TABLE 3-continued

Amino acid sequences for trispecific CODV antibodies.

| ID | LC1 Sequence | HC1 Sequence | HC2 Sequence | LC2 Sequence |
|---|---|---|---|---|
| | YCQQGHTLPPT FGCGTKVEIKG GGGSGGGGSR TVAAPSVFIFPP SDEQLKSGTAS VTCLLNNFYPRE AKVQWKVDNAL QSGNSQESVTE QDSKDSTYSLV STLTLSKADYEK HKVYACEVTHQ GLSSPVTKSFN RGEC | KSTSGGTAALGCQV KDYFPEPVTVSWNS GALTSGVHTFPAVL QSSGLYSLSVVVTV PSSSLGTQTYICNV NHKPSNTKVDKKVE PKSCDKTHTCPPCP APEAAGGPSVFLFP PKPKDTLMISRTPEV TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG QPENNYKTTPPVLD SDGSFFLYSKLTVD KSRWQQGNVFSCS VMHEALHNHYTQKS LSLSPG | VSHEDPEVKFNWYVD GVEVHNAKTKPREEQ YNSTYRVVSVLTVLHQ DWLNGKEYKCKVSNK ALPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | |
| C6 CM + ds | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGCG TKVEIKGGGGS GGGGSDIQMTQ SPSSLSASVGD RVTITCRASQDI SNYLNWYQEKP GKAPKLLIYYTS RLRSGVPSRFS GSGSGTDFTLTI SSLQPEDFATY YCQQGHTLPPT FGCGTKVEIKG GGGSGGGGSR TVAAPSVFIFPP SDEQLKSGTAS VVCLLNNFYPR EAKVQWKVDNA LQSGNSQESVT EQDSKDSTYSL SSTLTLSKADYE KHKVYACEVTH QGLSSPVTKSF NRGEC | EVQLVQSGAEVKKP GASVKVSCKASGYT FTDSYMSWVRKAP GQCLEWIGDMYPD NGDSSYNQKFRER VTITRDTSTSTAYLE LSSLRSEDTAVYYC VLAPRWYFSVWGQ GTLVTVSSQVQLVE SGGGVVQPGRSLR LDCKASGITFSNSG MHWVRKAPGKCLE WVAVIWYDGSKRY YADSVKGRFTISRD NSKNTLFLQMNSLR AEDTAVYYCATNDD YWGQGTLVTVSSA STKGPSVFPLAPSS KSTSGGTAALGCLV KDYFPEPVTVSWNS GALTSGVHTFPAVL QSSGLYSLSSVVTV PSSSLGTQTYICNV NHKPSNTKVDKKVE PKSCDKTHTCPPCP APEAAGGPSVFLFP PKPKDTLMISRTPEV TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG QPENNYKTTPPVLD SDGSFFLYSKLTVD KSRWQQGNVFSCS VMHEALHNHYTQKS LSLSPG | QVQLVESGGGVVQP GRSLRLCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPEA AGGPSVFLFPPKPKD TLMISRTPEVTCVVVD VSHEDPEVKFNWYVD GVEVHNAKTKPREEQ YNSTYRVVSVLTVLHQ DWLNGKEYKCKVSNK ALPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |
| C7 CH1/Ck + CM + ds | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGCG | EVQLVQSGAEVKKP GASVKVSCKASGYT FTDSYMSWVRKAP GQCLEWIGDMYPD NGDSSYNQKFRER VTITRDTSTSTAYLE LSSLRSEDTAVYYC VLAPRWYFSVWGQ GTLVTVSSQVQLVE | QVQLVESGGGVVQP GRSLRLCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT KLEIKRTVAAPVF |

TABLE 3-continued

Amino acid sequences for trispecific CODV antibodies.

| ID | LC1 Sequence | HC1 Sequence | HC2 Sequence | LC2 Sequence |
|---|---|---|---|---|
| | TKVEIKGGGGS GGGGSDIQMTQ SPSSLSASVGD RVTITCRASQDI SNYLNWYQEKP GKAPKLLIYYTS RLRSGVPSRFS GSGSGTDFTLTI SSLQPEDFATY YCQQGHTLPPT FGCGTKVEIKG GGGSGGGGSR TVAAPSVFIFPP SDEQLKSGTAS VTCLLNNFYPRE AKVQWKVDNAL QSGNSQESVTE QDSKDSTYSLV STLTLSKADYEK HKVYACEVTHQ GLSSPVTKSFN RGEC | SGGGVVQPGRSLR LDCKASGITFSNSG MHWVRKAPGKCLE WVAVIWYDGSKRY YADSVKGRFTISRD NSKNTLFLQMNSLR AEDTAVYYCATNDD YWGQGTLVTVSSA STKGPSVFPLAPSS KSTSGGTAALGCQV KDYFPEPVTVSWNS GALTSGVHTFPAVL QSSGLYSLVSVVTV PSSSLGTQTYICNV NHKPSNTKVDKKVE PKSCDKTHTCPPCP APEAAGGPSVFLFP PKPKDTLMISRTPEV TCVVVDVSHEDPEV KFNWYVDGVEVHN AKTKPREEQYNSTY RVVSVLTVLHQDWL NGKEYKCKVSNKAL PAPIEKTISKAKGQP REPQVYTLPPCRDE LTKNQVSLWCLVKG FYPSDIAVEWESNG QPENNYKTTPPVLD SDGSFFLYSKLTVD KSRWQQGNVFSCS VMHEALHNHYTQKS LSLSPG | LAPSSKSTSGGTAAL GCLVKDYFPEPVTVS WNSGALTSGVHTFPA VLQSSGLYSLSSVVEV PSSSLGTQTYICNVNH KPSNTKVDKKVEPKS CDKTHTCPPCPAPEA AGGPSVFLFPPKPKD TLMISRTPEVTCVVVD VSHEDPEVKFNWYVD GVEVHNAKTKPREEQ YNSTYRVVSVLTVLHQ DWLNGKEYKCKVSNK ALPAPIEKTISKAKGQP REPQVCTLPPSRDEL TKNQVSLSCAVKGFY PSDIAVEWESNGQPE NNYKTTPPVLDSDGS QGNVFSCSVMHEALH NRFTQKSLSLSPG | IFPPSDEQLKSGT ASVVCLLKNFYPR EAKVQWKVDNAL QSGNSQESVTEQ DSKDSTYSLSSTL TLSKADYEKHKVY ACEVTHQGLSSP VTKSFNRGEC |

TABLE 4

Amino acid sequences for bispecific Y-shaped antibodies.

| ID | LC1 Sequence | HC1 Sequence | LC2 Sequence | HC2 Sequence |
|---|---|---|---|---|
| Y1 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVVCLLNN FYPREAKVQWK VDNALQSGNSQ ESVTEQDSKDS TYSLESTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPLAPSSKSTSG GTAALGCRVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVVCLLNNFY PREAKVQWKVDNALQ SGNSQESVTEQDSKD STYSLRSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPLA PSSKSTSGGTAAL GCEVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSPG | | PVLDSDGSFFLVSKLTVDKSRWQQGNVFSCSVMHEALHNRFTQKSLSLSPGGAAHHHHHH |
| Y2 | DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC | EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCHVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC | QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH |
| Y3 | DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC | EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCHVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQGNVFSCSVMHEA | EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLHSTLTLSKADYEKHKVYACEVTHQGLSSPVTKSFNRGEC | QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSP G | | PVLDSDGSFFLVS KLTVDKSRWQQG NVFSCSVMHEAL HNRFTQKSLSLSP GGAAHHHHHH |
| Y4 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVVCLLNN FYPREAKVQWK VDNALQSGNSQ ESVTEQDSKDS TYSLDSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPLAPSSKSTSG GTAALGCRVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVVCLLNNFY PREAKVQWKVDNALQ SGNSQESVTEQDSKD STYSLRSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPLA PSSKSTSGGTAAL GCDVKDYFPEPV TVSWNSGALTSG VHTFPAVLQSSGL YSLSSVVTVPSSS LGTQTYICNVNHK PSNTKVDKKVEPK SCDKTHTCPPCP APELLGGPSVFLF PPKPKDTLMISRT PEVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP PVLDSDGSFFLVS KLTVDKSRWQQG NVFSCSVMHEAL HNRFTQKSLSLSP GGAAHHHHHH |
| Y5 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVVCLLNN FYPREAKVQWK VDNALQSGNSQ ESVTEQDSKDS TYSLDSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPLAPSSKSTSG GTAALGCKVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVVCLLNNFY PREAKVQWKVDNALQ SGNSQESVTEQDSKD STYSLKSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPLA PSSKSTSGGTAAL GCDVKDYFPEPV TVSWNSGALTSG VHTFPAVLQSSGL YSLSSVVTVPSSS LGTQTYICNVNHK PSNTKVDKKVEPK SCDKTHTCPPCP APELLGGPSVFLF PPKPKDTLMISRT PEVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSPG | | PVLDSDGSFFLVSKLTVDKSRWQQGNVFSCSVMHEALHNRFTQKSLSLSPGGAAHHHHHH |
| Y6 | DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLDSTLTLSKADYEKHKVYACEVTHQGLSSPVTKSFNRGEC | EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCHVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLHSTLTLSKADYEKHKVYACEVTHQGLSSPVTKSFNRGEC | QVQLVESGGGVVQPGRSLRLDCKASGITFSNSGMHWVREAPGKGLEWVAVIWYDGSKRYADSVKGRFTISRDNSKNTLFLQMNSLRAEDTAVYYCATNDDYWGQGTLVTVSSASTKGPSVFPLAPSSKSTSGGTAALGCDVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH |
| Y7 | DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC | EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPRAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQGNVFSCSVMHEA | EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVRCLLNNFYPREAKVQWKVDNALQSGNSQESVTEQDSKDSTYSLSSTLTLSKADYEKHKVYACEVTHQGLSSPVTKSFNRGEC | QVQLVESGGGVVQPGRSLRLDCKASGITFSNSGMHWVREAPGKGLEWVAVIWYDGSKRYADSVKGRFTISRDNSKNTLFLQMNSLRAEDTAVYYCATNDDYWGQGTLVTVSSASTKGPSVFPEASSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSP G | | PVLDSDGSFFLVS KLTVDKSRWQQG NVFSCSVMHEAL HNRFTQKSLSLSP GGAAHHHHHH |
| Y8 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVECLLNN FYPREAKVQWK VDNALQSGNSQ ESVTEQDSKDS TYSLSSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPKAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVKCLLNNFY PREAKVQWKVDNALQ SGNSQESVTEQDSKD STYSLSSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPEA PSSKSTSGGTAAL GCLVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP PVLDSDGSFFLVS KLTVDKSRWQQG NVFSCSVMHEAL HNRFTQKSLSLSP GGAAHHHHHH |
| Y9 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVECLLNN FYPREAKVQWK VDNALQSGNSQ ESVTEQDSKDS TYSLSSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPHAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVHCLLNNFY PREAKVQWKVDNALQ SGNSQESVTEQDSKD STYSLSSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPEA PSSKSTSGGTAAL GCLVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSP G | | PVLDSDGSFFLVS KLTVDKSRWQQG NVFSCSVMHEAL HNRFTQKSLSLSP GGAAHHHHHH |
| Y10 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVDCLLNN FYPREAKVQWK VDNALQSGNSQ ESVTEQDSKDS TYSLSSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPRAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVRCLLNNFY PREAKVQWKVDNALQ SGNSQESVTEQDSKD STYSLSSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPDA PSSKSTSGGTAAL GCLVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP PVLDSDGSFFLVS KLTVDKSRWQQG NVFSCSVMHEAL HNRFTQKSLSLSP GGAAHHHHHH |
| Y11 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVDCLLNN FYPREAKVQWK VDNALQSGNSQ ESVTEQDSKDS TYSLSSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPKAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVKCLLNNFY PREAKVQWKVDNALQ SGNSQESVTEQDSKD STYSLSSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPDA PSSKSTSGGTAAL GCLVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LHNHYTQKSLSLSP G | | PVLDSDGSFFLVS KLTVDKSRWQQG NVFSCSVMHEAL HNRFTQKSLSLSP GGAAHHHHHH |
| Y12 | DIQMTQSPSSLS ASVGDRVTITCR ASQDISNYLNW YQEKPGKAPKL LIYYTSRLRSGV PSRFSGSGSGT DFTLTISSLQPE DFATYYCQQGH TLPPTFGQGTK VEIKRTVAAPSV FIFPPSDEQLKS GTASVDCLLNN FYPREAKVQWK VDNALQSGNSQ ESVTEQDSKDS TYSLSSTLTLSK ADYEKHKVYAC EVTHQGLSSPV TKSFNRGEC | EVQLVQSGAEVKKP GASVKVSCKASGYT FTDSYMSWVRKAP GQGLEWIGDMYPD NGDSSYNQKFRER VTITRDTSTSTAYLE LSSLRSEDTAVYYC VLAPRWYFSVWGQ GTLVTVSSASTKGP SVFPHAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EIVLTQSPATLSLSPG ERATLSCRASQSVSS YLAWYQKKPGQAPRL LIYDASNRATGIPARF SGSGSGTDFTLTISSL EPEDFAVYYCQQSSN WPRTFGQGTKVEIKR TVAAPSVFIFPPSDEQ LKSGTASVHCLLNNFY PREAKVQKVDNALQ SGNSQESVTEQDSKD STYSLSSTLTLSKADY EKHKVYACEVTHQGL SSPVTKSFNRGEC | QVQLVESGGGVV QPGRSLRLDCKA SGITFSNSGMHW VREAPGKGLEWV AVIWYDGSKRYYA DSVKGRFTISRDN SKNTLFLQMNSLR AEDTAVYYCATND DYWGQGTLVTVS SASTKGPSVFPDA PSSKSTSGGTAAL GCLVKDYFPEPVT VSWNSGALTSGV HTFPAVLQSSGLY SLSSVVTVPSSSL GTQTYICNVNHKP SNTKVDKKVEPKS CDKTHTCPPCPA PELLGGPSVFLFP PKPKDTLMISRTP EVTCVVVDVSHE DPEVKFNWYVDG VEVHNAKTKPREE QYNSTYRVVSVLT VLHQDWLNGKEY KCKVSNKALPAPI EKTISKAKGQPRE PQVCTLPPSRDEL TKNQVSLSCAVK GFYPSDIAVEWES NGQPENNYKTTP PVLDSDGSFFLVS KLTVDKSRWQQG NVFSCSVMHEAL HNRFTQKSLSLSP GGAAHHHHHH |
| Y13 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDKK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDEQLKSG TASVVCLLNNFYP REAKVQWKVDNA LQSGNSQESVTE QDSKDSTYSLSST LTLSKADYEKHKV YACEVTHQGLSS PVTKSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| Y14 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL VSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDK KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPAV FIFPPSDEQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y15 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQY ICNVNHKPSNTKVDKK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDEQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y16 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPAV |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | LAPSSKSTSGGTAA LGCQVKDYFPEPVT VSWNSGALTSGVH TFPAVLQSSGLYSL VSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | GGTAALGCLVKDYFP EPVTVSWNSGALTSG VHTFPAVLQSSGLYSL SSVVEVPSSSLGTQT YICNVNHKPSNTKVDK KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | FIFPPSDEQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y17 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL VSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQT ICNVNHKPSNTKVDKK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDEQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y18 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDK KVEPKSCDKTHTCPP CPAPELLGGPSVFLFP PKPKDTLMISRTPEVT CVVVDVSHEDPEVKF | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDEQLKSG TASVVCLLKNFYP REAKVQWKVDNA LQSGNSQESVTE QDSKDSTYSLSST LTLSKADYEKHKV YACEVTHQGLSS PVTKSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | PVTKSFNRGEC | SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | |
| Y19 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVTCLLN NFYPREAKVQW KVDNALQSGNS QESVTEQDSKD STYSLVSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCQVKDYFPEPV TVSWNSGALTSGV HTFPAVLQSSGLYS LVSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY TYICNVNHKPSNTKVD KKVEPKSCDTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDEQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |
| Y20 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVTCLLN NFYPREAKVQW KVDNALQSGNS QESVTEQDSKD STYSLVSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCQVKDYFPEPV TVSWNSGALTSGV HTFPAVLQSSGLYS LVSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY TYICNVNHKPSNTKVD KKVEPKSCDTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDEQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | ESNGQPENNYKTTPP VLDSDGSFFLVSKLTV DKSRWQQGNVFSCS VMHEALHNRFTQKSL SLSPG | |
| Y21 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD KKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPSVFI FPPSDEQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |
| Y22 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLSSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVEVPSSSLGTQ TYICNVNHKPSNTKVD KKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDEQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | FLYSKLTVDKSRWQ QGNVFSCSVMHEA LHNHYTQKSLSLSP G | | |
| Y23 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDEK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDKQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y24 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLVSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL SVVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDEK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIFPPSDKQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y25 | EIVLTQSPATLS LSPGERATLSC RASQSVSSYLA WYQQKPGQAP | QVQLVESGGGVVQ PGRSLRLDCKASGI TFSNSGMHWVRQA PGKGLEWVAVIWYD | EVQLVQSGAEVKKPG ASVKVSCKASGYTFT DSYMSWVRQAPGQG LEWIGDMYPDNGSS | DIQMTQSPSSLSA SVGDRVTITCRAS QDISNYLNWYQQ KPGKAPKLLIYYTS |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDE KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | RLRSGVPSRFSG SGSGTDFTLTISSL QPEDFATYYCQQ GHTLPPTFGQGT KVEIKRTVAAPAV FIFPPSDKQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y26 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL VSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDE KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPAV FIFPPSDKQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y27 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL | EVQLVQSGAEVKKPG ASVKVSCKASGYTFT DSYMSWVRQAPGQG LEWIGDMYPDNGSS YNQKFRERVTITRDTS TSTAYLELSSLRSEDT AVYYCVLAPRWYFSV WGQGTLVTVSSASTK GPSVFPLAPSSKSTS GGTAALGCQVKDYFP EPVTVSWNSGALTSG VHTFPAVLQSSGLYSL VSVVEVPSSSLGTQT | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPAV FIFPPSDEQLKSG TASVTCLLKNFYP REAKVQWKVDNA LQSGNSQESVTE |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | WKVDNALQSGN SQESVTEQDSK DSTYSLSSTLTL SKADYEKHKVY ACEVTHQGLSS PVTKSFNRGEC | SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | YICNVNHKPSNTKVDK KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | QDSKDSTYSLVST LTLSKADYEKHKV YACEVTHQGLSS PVTKSFNRGEC |
| Y28 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLSSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPSVFI FPPSDKQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |
| Y29 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVTCLLN NFYPREAKVQW KVDNALQSGNS QESVTEQDSKD STYSLVSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCQVKDYFPEPV TVSWNSGALTSGV HTFPAVLQSSGLYS LVSVVTVPSSSLGT QTYICNVNHKPSNT KVDKKVEPKSCDKT HTCPPCPAPELLGG PSVFLFPPKPKDTL MISRTPEVTCVVVD | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPSVFI FPPSDKQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | |
| Y30 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLSSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVEVPSSSLGTQ TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDKQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |
| Y31 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLVSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCQVKDYFPEPV TVSWNSGALTSGV HTFPAVLQSSGLYS LVSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVEVPSSSLGTQ TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDKQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | ESNGQPENNYKTTPP VLDSDGSFFLVSKLTV DKSRWQQGNVFSCS VMHEALHNRFTQKSL SLSPG | |
| Y32 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLSSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCQVKDYF PEPVTVSWNSGALTS GVHTFPAVLQSSGLY SLVSVVEVPSSSLGTQ TYICNVNHKPSNTKVD KKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPAVFI FPPSDEQLKSGTA SVTCLLKNFYPRE AKVQWKVDNALQ SGNSQESVTEQD SKDSTYSLVSTLT LSKADYEKHKVYA CEVTHQGLSSPVT KSFNRGEC |
| Y33 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDEK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSDKQLKSG TASVVCLLNNFYP REAKVQWKVDNA LQSGNSQESVTE QDSKDSTYSLSST LTLSKADYEKHKV YACEVTHQGLSS PVTKSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | GNVFSCSVMHEALH NHYTQKSLSLSPG | | |
| Y34 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDEK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSDKQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y35 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDE KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSDKQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y36 | EIVLTQSPATLS LSPGERATLSC RASQSVSSYLA WYQEKPGQAP RLLIYDASNRAT GIPARFSGSGS | QVQLVESGGGVVQ PGRSLRLDCKASGI TFSNSGMHWVRKA PGKGLEWVAVIWYD GSKRYYADSVKGRF TISRDNSKNTLFLQ | EVQLVQSGAEVKKPG ASVKVSCKASGYTFT DSYMSWVREAPGQG LEWIGDMYPDNGDSS YNQKFRERVTITRDTS TSTAYLELSSLRSEDT | DIQMTQSPSSLSA SVGDRVTITCRAS QDISNYLNWYQK KPGKAPKLLIYYTS RLRSGVPSRFSG SGSGTDFTLTISSL |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | GTDFTLTISSLE PEDFAVYYCQQ SSNWPRTFGQ GTKVEIKRTVAA PSVFIFPPSDEQ LKSGTASVTCLL NNFYPREAKVQ WKVDNALQSGN SQESVTEQDSK DSTYSLVSTLTL SKADYEKHKVY ACEVTHQGLSS PVTKSFNRGEC | MNSLRAEDTAVYYC ATNDDYWGQGTLV TVSSASTKGPSVFP LAPSSKSTSGGTAA LGCQVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVEVPSSSLGTQT YICNVNHKPSNTKVDE KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | QPEDFATYYCQQ GHTLPPTFGQGT KVEIKRTVAAPAV FIFPPSDEQLKSG TASVVCLLKNFYP REAKVQWKVDNA LQSGNSQESVTE QDSKDSTYSLSST LTLSKADYEKHKV YACEVTHQGLSS PVTKSFNRGEC |
| Y37 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCQVKDYFP EPVTVSWNSGALTSG VHTFPAVLQSSGLYSL VSVVEVPSSSLGTQT YICNVNHKPSNTKVDK KVEPKSCDKTHTCPP CPAPELLGGPSVFLFP PKPKDTLMISRTPEVT CVVVDVSHEDPEVKF NWYVDGVEVHNAKTK PREEQYNSTYRVVSV LTVLHQDWLNGKEYK CKVSNKALPAPIEKTIS KAKGQPREPQVCTLP PSRDELTKNQVSLSC AVKGFYPSDIAVEWE SNGQPENNYKTTPPV LDSDGSFFLVSKLTVD KSRWQQGNVFSCSV MHEALHNRFTQKSLS LSPG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPAV FIFPPSDEQLKSG TASVTCLLKNFYP REAKVQWKVDNA LQSGNSQESVTE QDSKDSTYSLSST LTLSKADYEKHKV YACEVTHQGLSS PVTKSFNRGEC |
| Y38 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPVT VSWNSGALTSGV HTFPAVLQSSGLYS LSSVVTVPSSSLGT | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD EKVEPKSCDKTHTCP | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPSVFI FPPSDEQLKSG SVVCLLNNFYPRE AKVQWKVDNALQ SGNSQESVTEQD SKDSTYSLSSTLT LSKADYEKHKVYA |

TABLE 4-continued

Amino acid sequences for bispecific Y-shaped antibodies.

| ID | LC1 Sequence | HC1 Sequence | LC2 Sequence | HC2 Sequence |
| --- | --- | --- | --- | --- |
| | TYSLSSTLTLSK ADYEKHKVYAC EVTHQGLSSPV TKSFNRGEC | QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | CEVTHQGLSSPVT KSFNRGEC |
| Y39 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVTCLLNNF YPREAKVQWKV DNALQSGNSQE SVTEQDSKDST YSLVSTLTLSKA DYEKHKVYACE VTHQGLSSPVT KSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCQVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPSVFI FPPSDKQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |
| Y40 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPAVFI FPPSDKQLKSGTA SVVCLLNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
| --- | --- | --- | --- | --- |
| | | VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | |
| Y41 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVTCLLNNF YPREAKVQWKV DNALQSGNSQE SVTEQDSKDST YSLVSTLTLSKA DYEKHKVYACE VTHQGLSSPVT KSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVEVPSSSLGTQ TYICNVNHKPSNTKVD EKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPAVFI FPPSDKQLKSGTA SVVCLLKNFYPRE AKVQWKVDNALQ SGNSQESVTEQD SKDSTYSLSSTLT LSKADYEKHKVYA CEVTHQGLSSPVT KSFNRGEC |
| Y42 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSVVEVPSSSLGTQ TYICNVNHKPSNTKVD KKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPAVFI FPPSDEQLKSGTA SVTCLLKNFYPRE AKVQWKVDNALQ SGNSQESVTEQD SKDSTYSLVSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | ESNGQPENNYKTTPP VLDSDGSFFLVSKLTV DKSRWQQGNVFSCS VMHEALHNRFTQKSL SLSPG | |
| Y43 | EIVLTQSPATLS LSPGERATLSC RASQSVSSYLA WYQQKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRQA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | QVQLVESGGGVVQP GRSLRLSCAASGFTF SSYGMHWVRQAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQQ KPGKAPKLLIYDA SSLESGVPSRFSG SGSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |
| Y44 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLSSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCLVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | QVQLVESGGGVVQP GRSLRLSCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDEKVEPDS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT KLEIKRTVAAPSVF IFPPSKKQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| Y45 | EIVLTQSPATLS LSPGERATLSC RASQSVSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLRSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCEVKDYFPEPVT VSWNSGALTSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | QVQLVESGGGVVQP GRSLRLSCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCRVKDYFPEPVTVS WNSGALTSGVHTFPA VLQSSGLYSLSSVVTV PSSSLGTQTYICNVNH KPSNTKVDEKVEPDS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT KLEIKRTVAAPSVF IFPPSKKQLKSGT ASVVCLLNNFYPR EAKVQWKVDNAL QSGNSQESVTEQ DSKDSTYSLESTL TLSKADYEKHKVY ACEVTHQGLSSP VTKSFNRGEC |
| Y46 | DIQMTQSPSSLS ASVGDRVTITCR ASQGIRNYLAW YQQKPGKAPKL LIYAASTLQSGV PSRFSGSGSGT DFTLTISSLQPE DVATYYCQRYN RAPYTFGQGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | EVQLVESGGGLVQP GRSLRLSCAASGFT FDDYAMHWVRQAP GKGLEWVSAITWNS GHIDYADSVEGRFTI SRDNAKNSLYLQMN SLRAEDTAVYYCAK VSYLSTASSLDYWG QGTLVTVSSASTKG PSVFPLAPSSKSTS GGTAALGCLVKDYF PEPVTVSWNSGALT SGVHTFPAVLQSSG LYSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | QVQLVESGGGVVQP GRSLRLSCAASGFTF SSYGMHWVRQAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDKKVEPKS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQQ KPGKAPKLLIYDA SSLESGVPSRFSG SGSGTDFTLTISSL QPEDFATYYCQQ FNSYPYTFGQGT KLEIKRTVAAPSVF IFPPSDEQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |
| Y47 | DIQMTQSPSSLS ASVGDRVTITCR ASQGIRNYLAW YQEKPGKAPKL LIYAASTLQSGV PSRFSGSGSGT DFTLTISSLQPE DVATYYCQRYN | EVQLVESGGGLVQP GRSLRLSCAASGFT FDDYAMHWVRKAP GKGLEWVSAITWNS GHIDYADSVEGRFTI SRDNAKNSLYLQMN SLRAEDTAVYYCAK VSYLSTASSLDYWG | QVQLVESGGGVVQP GRSLRLSCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | RAPYTFGQGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | QGTLVTVSSASTKG PSVFPLAPSSKSTS GGTAALGCLVKDYF PEPVTVSWNSGALT SGVHTFPAVLQSSG LYSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | TVTVSSASTKGPSVFP LAPSSKSTSGGTAAL GCLVKDYFPEPVTVS WNSGALTSGVHTFPA VLQSSGLYSLSSVVTV PSSSLGTQTYICNVNH KPSNTKVDEKVEPDS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | KLEIKRTVAAPSVF IFPPSKKQLKSGT ASVVCLLNNFYPR EAKVQWKVDNAL QSGNSQESVTEQ DSKDSTYSLSSTL TLSKADYEKHKVY ACEVTHQGLSSP VTKSFNRGEC |
| Y48 | DIQMTQSPSSLS ASVGDRVTITCR ASQGIRNYLAW YQEKPGKAPKL LIYAASTLQSGV PSRFSGSGSGT DFTLTISSLQPE DVATYYCQRYN RAPYTFGQGTK VEIKRTVAAPSV FIFPPSDEQLKS GTASVVCLLNN FYPREAKVQWK VDNALQSGNSQ ESVTEQDSKDS TYSLRSTLTLSK ADYEKHKVYAC EVTHQGLSSPV TKSFNRGEC | EVQLVESGGGLVQP GRSLRLSCAASGFT FDDYAMHWVRKAP GKGLEWVSAITWNS GHIDYADSVEGRFTI SRDNAKNSLYLQMN SLRAEDTAVYYCAK VSYLSTASSLDYWG QGTLVTVSSASTKG PSVFPLAPSSKSTS GGTAALGCEVKDYF PEPVTVSWNSGALT SGVHTFPAVLQSSG LYSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | QVQLVESGGGVVQP GRSLRLSCAASGFTF SSYGMHWVREAPGK GLEWVAVIWYEGSNK YYADSVKGRFTISRDN SKNTLYLQMNSLRAE DTAVYYCARGGSMVR GDYYYGMDVWGQGT TVTVSSASTKGPSVFP LAPSSKSTSGGTAAL GCRVKDYFPEPVTVS WNSGALTSGVHTFPA VLQSSGLYSLSSVVTV PSSSLGTQTYICNVNH KPSNTKVDEKVEPDS CDKTHTCPPCPAPELL GGPSVFLFPPKPKDTL MISRTPEVTCVVVDVS HEDPEVKFNWYVDGV EVHNAKTKPREEQYN STYRVVSVLTVLHQD WLNGKEYKCKVSNKA LPAPIEKTISKAKGQP REPQVCTLPPSRDEL TKNQVSLSCAVKGFY PSDIAVEWESNGQPE NNYKTTPPVLDSDGS FFLVSKLTVDKSRWQ QGNVFSCSVMHEALH NRFTQKSLSLSPG | AIQLTQSPSSLSA SVGDRVTITCRAS QGISSALAWYQKK PGKAPKLLIYDAS SLESGVPSRFSGS GSGTDFTLTISSL QPEDFATYYCQQ FNSYPYTFGQGT KLEIKRTVAAPSVF IFPPSKKQLKSGT ASVVCLLNNFYPR EAKVQWKVDNAL QSGNSQESVTEQ DSKDSTYSLESTL TLSKADYEKHKVY ACEVTHQGLSSP VTKSFNRGEC |
| Y49 | DIQMTQSPSSLS ASVGDRVTITCR ASQGIRNYLAW YQQKPGKAPKL LIYAASTLQSGV PSRFSGSGSGT DFTLTISSLQPE DVATYYCQRYN RAPYTFGQGTK VEIKRTVAAPSV FIFPPSDEQLKS GTASVVCLLNN FYPREAKVQWK VDNALQSGNSQ ESVTEQDSKDS | EVQLVESGGGLVQP GRSLRLSCAASGFT FDDYAMHWVRQAP GKGLEWVSAITWNS GHIDYADSVEGRFTI SRDNAKNSLYLQMN SLRAEDTAVYYCAK VSYLSTASSLDYWG QGTLVTVSSASTKG PSVFPLAPSSKSTS GGTAALGCLVKDYF PEPVTVSWNSGALT SGVHTFPAVLQSSG LYSLSSVVTVPSSSL GTQTYICNVNHKPS | EVQLVQSGAEVKKPG ASVKVSCKASGFTFT DSYMSWVRQAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDKK VEPKSCDKTHTCPPC | DIQMTQSPSSLSA SVGDRVTITCRAS QDISNYLNWYQQ KPGKAPKLLIYYTS RLRSGVPSRFSG SGSGTDFTLTISSL QPEDFATYYCQQ GHTLPPTFGQGT KVEIKRTVAAPSV FIPPPSDEQLKSG TASVVCLLNNFYP REAKVQWKVDNA LQSGNSQESVTE QDSKDSTYSLSST LTLSKADYEKHKV |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | TYSLSSTLTLSK ADYEKHKVYAC EVTHQGLSSPV TKSFNRGEC | NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | YACEVTHQGLSS PVTKSFNRGEC |
| Y50 | DIQMTQSPSSLS ASVGDRVTITCR ASQGIRNYLAW YQEKPGKAPKL LIYAASTLQSGV PSRFSGSGSGT DFTLTISSLQPE DVATYYCQRYN RAPYTFGQGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | EVQLVESGGGLVQP GRSLRLSCAASGFT FDDYAMHWVRKAP GKGLEWVSAITWNS GHIDYADSVEGRFTI SRDNAKNSLYLQMN SLRAEDTAVYYCAK VSYLSTASSLDYWG QGTLVTVSSASTKG PSVFPLAPSSKSTS GGTAALGCLVKDYF PEPVTVSWNSGALT SGVHTFPAVLQSSG LYSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCLVKDYFP EPVTVSWNSGALTSG VHTFPAVLQSSGLYSL SSVVTVPSSSLGTQTY ICNVNHKPSNTKVDEK VEPDSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSKKQLKSG TASVVCLLNNFYP REAKVQWKVDNA LQSGNSQESVTE QDSKDSTYSLSST LTLSKADYEKHKV YACEVTHQGLSS PVTKSFNRGEC |
| Y51 | DIQMTQSPSSLS ASVGDRVTITCR ASQGIRNYLAW YQEKPGKAPKL LIYAASTLQSGV PSRFSGSGSGT DFTLTISSLQPE DVATYYCQRYN RAPYTFGQGTK VEIKRTVAAPSV FIFPPSDEQLKS GTASVVCLLNN FYPREAKVQWK VDNALQSGNSQ ESVTEQDSKDS TYSLRSTLTLSK ADYEKHKVYAC EVTHQGLSSPV TKSFNRGEC | EVQLVESGGGLVQP GRSLRLSCAASGFT FDDYAMHWVRKAP GKGLEWVSAITWNS GHIDYADSVEGRFTI SRDNAKNSLYLQMN SLRAEDTAVYYCAK VSYLSTASSLDYWG QGTLVTVSSASTKG PSVFPLAPSSKSTS GGTAALGCEVKDYF PEPVTVSWNSGALT SGVHTFPAVLQSSG LYSLSSVVTVPSSSL GTQTYICNVNHKPS NTKVDKKVEPKSCD KTHTCPPCPAPELL GGPSVFLFPPKPKD TLMISRTPEVTCVVV DVSHEDPEVKFNW YVDGVEVHNAKTKP REEQYNSTYRVVSV | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCRVKDYFP EPVTVSWNSGALTSG VHTFPAVLQSSGLYSL SSVVTVPSSSLGTQTY ICNVNHKPSNTKVDEK VEPDSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSKKQLKSG TASVVCLLNNFYP REAKVQWKVDNA LQSGNSQESVTE QDSKDSTYSLEST LTLSKADYEKHKV YACEVTHQGLSS PVTKSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | LTVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | |
| Y52 | DIQMTQSPSSV SASVGDRVTITC RASQGIYSWLA WYQQKPGKAP NLLIYTASTLQS GVPSRFSGSGS GTDFTLTISSLQ PEDFATYYCQQ ANIFPLTFGGGT KVEIKRTVAAPS VFIFPPSDEQLK SGTASVVCLLN NFYPREAKVQW KVDNALQSGNS QESVTEQDSKD STYSLSSTLTLS KADYEKHKVYA CEVTHQGLSSP VTKSFNRGEC | QVQLVQSGAEVKKP GASVKVSCKASGYT FTGYYMHWVRQAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVRQAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD KKVEPKSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQQ KPGKAPKLLIYSA SFLYSGVPSRFSG SGSGTDFTLTISSL QPEDFATYYCQQ YLYHPATFGQGTK VEIKRTVAAPSVFI FPPSDEQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |
| Y53 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS TYSLSSTLTLSK ADYEKHKVYAC EVTHQGLSSPV TKSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCLVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCLVKDYF PEPVTVSWNSGALTS GVHTFPAVLQSSGLY SLSSVVTVPSSSLGTQ TYICNVNHKPSNTKVD EKVEPDSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPSVFI FPPSKKQLKSGTA SVVCLLNNFYPRE AKVQWKVDNALQ SGNSQESVTEQD SKDSTYSLSSTLT LSKADYEKHKVYA CEVTHQGLSSPVT KSFNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | | IAVEWESNGQPENN YKTTPPVLDSDGSF FLYSKLTVDKSRWQ QGNVFSCSVMHEA LHNHYTQKSLSLSP G | VMHEALHNRFTQKSL SLSPG | |
| Y54 | DIQMTQSPSSV SASVGDRVTITC RASQGIYSWLA WYQEKPGKAPN LLIYTASTLQSG VPSRFSGSGSG TDFTLTISSLQP EDFATYYCQQA NIFPLTFGGGTK VEIKRTVAAPSV FIFPPSDEQLKS GTASVVCLLNN FYPREAKVQWK VDNALQSGNSQ ESVTEQDSKDS TYSLRSTLTLSK ADYEKHKVYAC EVTHQGLSSPV TKSFNRGEC | QVQLVQSGAEVKKP GASVKVSCKASGYT FTGYYMHWVRKAP GQGLEWMGWINPD SGGTNYAQKFQGR VTMTRDTSISTAYM ELNRLRSDDTAVYY CARDQPLGYCTNG VCSYFDYWGQGTL VTVSSASTKGPSVF PLAPSSKSTSGGTA ALGCEVKDYFPEPV TVSWNSGALTSGV HTFPAVLQSSGLYS LSSVVTVPSSSLGT QTYICNVNHKPSNT KVDKKVEPKSCDKT HTCPPCPAPELLGG PSVFLFPPKPKDTL MISRTPEVTCVVVD VSHEDPEVKFNWY VDGVEVHNAKTKPR EEQYNSTYRVVSVL TVLHQDWLNGKEY KCKVSNKALPAPIEK TISKAKGQPREPQV YTLPPCRDELTKNQ VSLWCLVKGFYPSD IAVEWESNGQPENN YKTTPPVLDSDGSF FLYSKLTVDKSRWQ QGNVFSCSVMHEA LHNHYTQKSLSLSP G | EVQLVESGGGLVQPG GSLRLSCAASGFTFS DSWIHWVREAPGKGL EWVAWISPYGGSTYY ADSVKGRFTISADTSK NTAYLQMNSLRAEDT AVYYCARRHWPGGF DYWGQGTLVTVSSAS TKGPSVFPLAPSSKST SGGTAALGCRVKDYF PEPVTVSWNSGALTS GVHTFPAVLQSSGLY SLSSVVTVPSSSLGTQ TYICNVNHKPSNTKVD EKVEPDSCDKTHTCP PCPAPELLGGPSVFLF PPKPKDTLMISRTPEV TCVVVDVSHEDPEVK FNWYVDGVEVHNAKT KPREEQYNSTYRVVS VLTVLHQDWLNGKEY KCKVSNKALPAPIEKTI SKAKGQPREPQVCTL PPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIQMTQSPSSLSA SVGDRVTITCRAS QDVSTAVAWYQK KPGKAPKLLIYSA SFLYSGVPSRFSG SGSGTDFTLTISSL QPEDFATYYCQQ YLYHPATFGQGTK VEIKRTVAAPSVFI FPPSKKQLKSGTA SVVCLLNNFYPRE AKVQWKVDNALQ SGNSQESVTEQD SKDSTYSLESTLT LSKADYEKHKVYA CEVTHQGLSSPVT KSFNRGEC |
| Y55 | DIVMTQTPLSLS VTPGQPASISCK SSQSLVHENLQ TYLSWYLQKPG QSPQSLIYKVSN RFSGVPDRFSG SGSGTDFTLKIS RVEAEDVGVYY CGQGTQYPFTF GSGTKVEIKRTV AAPSVFIFPPSD EQLKSGTASVV CLLNNFYPREA KVQWKVDNALQ SGNSQESVTEQ DSKDSTYSLSST LTLSKADYEKHK VYACEVTHQGL SSPVTKSFNRG EC | QVQLVESGGGVVQ PGRSLRLSCAASGF TFTKAWMHWVRQA PGKQLEWVAQIKDK SNSYATYYADSVKG RFTISRDDSKNTLYL QMNSLRAEDTAVYY CRGVYYALSPFDY WGQGTLVTVSSAST KGPSVFPLAPSSKS TSGGTAALGCLVKD YFPEPVTVSWNSGA LTSGVHTFPAVLQS SGLYSLSSVVTVPS SSLGTQTYICNVNH KPSNTKVDKKVEPK SCDKTHTCPPCPAP ELLGGPSVFLFPPK PKDTLMISRTPEVTC VVVDVSHEDPEVKF NWYVDGVEVHNAK TKPREEQYNSTYRV VSVLTVLHQDWLNG KEYKCKVSNKALPA PIEKTISKAKGQPRE PQVYTLPPCRDELT KNQVSLWCLVKGFY PSDIAVEWESNGQP ENNYKTTPPVLDSD GSFFLYSKLTVDKS RWQQGNVFSCSVM HEALHNHYTQKSLS LSPG | EVQLVQSGAEVKKPG ESLKISCKGSGYSFTD YYMKWARQMPGKGL EWMGDIIPSSGATFYN QKFKGQVTISADKSIS TTYLQWSSLKASDTA MYYCARSHLLRASWF AYWGQGTMVTVSSA STKGPSVFPLAPSSKS TSGGTAALGCLVKDY FPEPVTVSWNSGALT SGVHTFPAVLQSSGL YSLSSVVTVPSSSLGT QTYICNVNHKPSNTKV DKKVEPKSCDKTHTC PPCPAPELLGGPSVFL FPPKPKDTLMISRTPE VTCVVVDVSHEDPEV KFNWYVDGVEVHNAK TKPREEQYNSTYRVV SVLTVLHQDWLNGKE YKCKVSNKALPAPIEK TISKAKGQPREPQVCT LPPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIVMTQSPDSLAV SLGERATINCESS QSLLNSGNQKNY LTWYQQKPGQPP KPLIYWASTRESG VPDRFSGSGSGT DFTLTISSLQAEDV AVYYCQNDYSYP YTFGQGTKLEIKR TVAAPSVFIFPPS DEQLKSGTASVV CLLNNFYPREAKV QWKVDNALQSGN SQESVTEQDSKD STYSLSSTLTLSK ADYEKHKVYACE VTHQGLSSPVTKS FNRGEC |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| Y56 | DIVMTQTPLSLS VTPGQPASISCK SSQSLVHENLQ TYLSWYLEKPG QSPQSLIYKVSN RFSGVPDRFSG SGSGTDFTLKIS RVEAEDVGVYY CGQGTQYPFTF GSGTKVEIKRTV AAPSVFIFPPSD EQLKSGTASVV CLLNNFYPREA KVQWKVDNALQ SGNSQESVTEQ DSKDSTYSLSST LTLSKADYEKHK VYACEVTHQGL SSPVTKSFNRG EC | QVQLVESGGGVVQ PGRSLRLSCAASGF TFTKAWMHWVRKA PGKQLEWVAQIKDK SNSYATYYADSVKG RFTISRDDSKNTLYL QMNSLRAEDTAVYY CRGVYYALSPFDY WGQGTLVTVSSAST KGPSVFPLAPSSKS TSGGTAALGCLVKD YFPEPVTVSWNSGA LTSGVHTFPAVLQS SGLYSLSSVVTVPS SSLGTQTYICNVNH KPSNTKVDKKVEPK SCDKTHTCPPCPAP ELLGGPSVFLFPPK PKDTLMISRTPEVTC VVVDVSHEDPEVKF NWYVDGVEVHNAK TKPREEQYNSTYRV VSVLTVLHQDWLNG KEYKCKVSNKALPA PIEKTISKAKGQPRE PQVYTLPPCRDELT KNQVSLWCLVKGFY PSDIAVEWESNGQP ENNYKTTPPVLDSD GSFFLYSKLTVDKS RWQQGNVFSCSVM HEALHNHYTQKSLS LSPG | EVQLVQSGAEVKKPG ESLKISCKGSGYSFTD YYMKWAREMPGKGL EWMGDIIPSSGATFYN QKFKGQVTISADKSIS TTYLQWSSLKASDTA MYYCARSHLLRASWF AYWGQGTMVTVSSA STKGPSVFPLAPSSKS TSGGTAALGCLVKDY FPEPVTVSWNSGALT SGVHTFPAVLQSSGL YSLSSVVTVPSSSLGT QTYICNVNHKPSNTKV DEKVEPDSCDKTHTC PPCPAPELLGGPSVFL FPPKPKDTLMISRTPE VTCVVVDVSHEDPEV KFNWYVDGVEVHNAK TKPREEQYNSTYRVV SVLTVLHQDWLNGKE YKCKVSNKALPAPIEK TISKAKGQPREPQVCT LPPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIVMTQSPDSLAV SLGERATINCESS QSLLNSGNQKNY LTWYQKKPGQPP KPLIYWASTRESG VPDRFSGSGSGT DFTLTISSLQAEDV AVYYCQNDYSYP YTFGQGTKLEIKR TVAAPSVFIFPPSK QKLKSGTASVVCL LNNFYPREAKVQ WKVDNALQSGNS QESVTEQDSKDS TYSLSSTLTLSKA DYEKHKVYACEVT HQGLSSPVTKSFN RGEC |
| Y57 | DIVMTQTPLSLS VTPGQPASISCK SSQSLVHENLQ TYLSWYLEKPG QSPQSLIYKVSN RFSGVPDRFSG SGSGTDFTLKIS RVEAEDVGVYY CGQGTQYPFTF GSGTKVEIKRTV AAPSVFIFPPSD EQLKSGTASVV CLLNNFYPREA KVQWKVDNALQ SGNSQESVTEQ DSKDSTYSLRS TLTLSKADYEKH KVYACEVTHQG LSSPVTKSFNR GEC | QVQLVESGGGVVQ PGRSLRLSCAASGF TFTKAWMHWVRKA PGKQLEWVAQIKDK SNSYATYYADSVKG RFTISRDDSKNTLYL QMNSLRAEDTAVYY CRGVYYALSPFDY WGQGTLVTVSSAST KGPSVFPLAPSSKS TSGGTAALGCEVKD YFPEPVTVSWNSGA LTSGVHTFPAVLQS SGLYSLSSVVTVPS SSLGTQTYICNVNH KPSNTKVDKKVEPK SCDKTHTCPPCPAP ELLGGPSVFLFPPK PKDTLMISRTPEVTC VVVDVSHEDPEVKF NWYVDGVEVHNAK TKPREEQYNSTYRV VSVLTVLHQDWLNG KEYKCKVSNKALPA PIEKTISKAKGQPRE PQVYTLPPCRDELT KNQVSLWCLVKGFY PSDIAVEWESNGQP ENNYKTTPPVLDSD GSFFLYSKLTVDKS RWQQGNVFSCSVM HEALHNHYTQKSLS LSPG | EVQLVQSGAEVKKPG ESLKISCKGSGYSFTD YYMKWAREMPGKGL EWMGDIIPSSGATFYN QKFKGQVTISADKSIS TTYLQWSSLKASDTA MYYCARSHLLRASWF AYWGQGTMVTVSSA STKGPSVFPLAPSSKS TSGGTAALGCRVKDY FPEPVTVSWNSGALT SGVHTFPAVLQSSGL YSLSSVVTVPSSSLGT QTYICNVNHKPSNTKV DEKVEPDSCDKTHTC PPCPAPELLGGPSVFL FPPKPKDTLMISRTPE VTCVVVDVSHEDPEV KFNWYVDGVEVHNAK TKPREEQYNSTYRVV SVLTVLHQDWLNGKE YKCKVSNKALPAPIEK TISKAKGQPREPQVCT LPPSRDELTKNQVSLS CAVKGFYPSDIAVEW ESNGQPENNYKTTPP VLDSDGSFFLVSKLTV DKSRWQQGNVFSCS VMHEALHNRFTQKSL SLSPG | DIVMTQSPDSLAV SLGERATINCESS QSLLNSGNQKNY LTWYQKKPGQPP KPLIYWASTRESG VPDRFSGSGSGT DFTLTISSLQAEDV AVYYCQNDYSYP YTFGQGTKLEIKR TVAAPSVFIFPPSK QKLKSGTASVVCL LNNFYPREAKVQ WKVDNALQSGNS QESVTEQDSKDS TYSLESTLTLSKA DYEKHKVYACEVT HQGLSSPVTKSFN RGEC |
| Y58 | EIVLTQSPATLS LSPGERATLSC RASQSVSSYLA WYQEKPGQAP RLLIYDASNRAT GIPARFSGSGS GTDFTLTISSLE | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV | DIQMTQSPSSLSA SVGDRVTITCRAS QDISNYLNWYQK KPGKAPKLLIYYTS RLRSGVPSRFSG SGSGTDFTLTISSL QPEDFATYYCQQ |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLRSTLTL SKADYEKHKVY ACEVTHQGLSS PVTKSFNRGEC | ATNDDYWGQGTLV TVSSASTKGPSVFP LAPSSKSTSGGTAA LGCEVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | WGQGTLVTVSSASTK GPSVFPLAPSSKSTS GGTAALGCRVKDYFP EPVTVSWNSGALTSG VHTFPAVLQSSGLYSL SSVVTVPSSSLGTQTY ICNVNHKPSNTKVDEK VEPKSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | GHTLPPTFGQGT KVEIKRTVAAPSV FIFPPSDKQLKSG TASVVCLLNNFYP REAKVQWKVDNA LQSGNSQESVTE QDSKDSTYSLEST LTLSKADYEKHKV YACEVTHQGLSS PVTKSFNRGEC |
| Y59 | EIVLTQSPATLS LSPGERATLSC RASQVSSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLRSTLTL SKADYEKHKVY ACEVTHQGLSS PVTKSFNRGEC | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCEVKDYFPEPVT VSWNSGALTSGVH TFPAVLQSSGLYSL SSVVTVPSSSLGTQ TYICNVNHKPSNTK VDKKVEPKSCDKTH TCPPCPAPELLGGP SVFLFPPKPKDTLMI SRTPEVTCVVVDVS HEDPEVKFNWYVD GVEVHNAKTKPREE QYNSTYRVVSVLTV LHQDWLNGKEYKC KVSNKALPAPIEKTI SKAKGQPREPQVYT LPPCRDELTKNQVS LWCLVKGFYPSDIA VEWESNGQPENNY KTTPPVLDSDGSFF LYSKLTVDKSRWQQ GNVFSCSVMHEALH NHYTQKSLSLSPG | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCRVKDYFP EPVTVSWNSGALTSG VHTFPAVLQSSGLYSL SSVVTVPSSSLGTQTY ICNVNHKPSNTKVDKK VEPSCDKTHTCPPC PAPELLGGPSVFLFPP KPKDTLMISRTPEVTC VVVDVSHEDPEVKFN WYVDGVEVHNAKTKP REEQYNSTYRVVSVL TVLHQDWLNGKEYKC KVSNKALPAPIEKTISK AKGQPREPQVCTLPP SRDELTKNQVSLSCA VKGFYPSDIAVEWES NGQPENNYKTTPPVL DSDGSFFLVSKLTVDK SRWQQGNVFSCSVM HEALHNRFTQKSLSLS PG | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSKEQLKSG TASVVCLLNNFYP REAKVQWKVDNA LQSGNSQESVTE QDSKDSTYSLEST LTLSKADYEKHKV YACEVTHQGLSS PVTKSFNRGEC |
| Y60 | EIVLTQSPATLS LSPGERATLSC RASQVSSSYLA WYQEKPGQAP RLLIYDASNRAT GIPARFSGSGS GTDFTLTISSLE PEDFAVYYCQQ SSNWPRTFGQ GTKVEIKRTVAA PSVFIFPPSDEQ LKSGTASVVCLL NNFYPREAKVQ WKVDNALQSGN SQESVTEQDSK DSTYSLRSTLTL | QVQLVESGGGVVQ PGRSLRLDCKASGI TFSNSGMHWVRKA PGKGLEWVAVIWYD GSKRYYADSVKGRF TISRDNSKNTLFLQ MNSLRAEDTAVYYC ATNDDYWGQGTLV TVSSASTKGPSVFP LAPSSKSTSGGTAA LGCEVKDYFPEPVT VSWNSGALTSGVH TFPAVLQSSGLYSL SSVVTVPSSSLGTQ TYICNVNHKPSNTK VDKKVEPKSCDKTH | EVQLVQSGAEVKKPG ASVKVSCKASGYTFT DSYMSWVREAPGQG LEWIGDMYPDNGDSS YNQKFRERVTITRDTS TSTAYLELSSLRSEDT AVYYCVLAPRWYFSV WGQGTLVTVSSASTK GPSVFPLAPSSKSTS GGTAALGCRVKDYFP EPVTVSWNSGALTSG VHTFPAVLQSSGLYSL SSVVTVPSSSLGTQTY ICNVNHKPSNTKVDKK VEPKSCDKTHTCPPC PAPELLGGPSVFLFPP | DIQMTQSPSSLSA SVGDRVTITCRAS QDISNYLNWYQK KPGKAPKLLIYYTS RLRSGVPSRFSG SGSGTDFTLTISSL QPEDFATYYCQQ GHTLPPTFGQGT KVEIKRTVAAPSV FIFPPSDEQLKSG TASVVCLLNNFYP REAKVQWKVDNA LQSGNSQESVTE QDSKDSTYSLEST LTLSKADYEKHKV YACEVTHQGLSS |

TABLE 4-continued

Amino acid sequences for bispecific Y-shaped antibodies.

| ID | LC1 Sequence | HC1 Sequence | LC2 Sequence | HC2 Sequence |
|---|---|---|---|---|
| | SKADYEKHKVY<br>ACEVTHQGLSS<br>PVTKSFNRGEC | TCPPCPAPELLGGP<br>SVFLFPPKPKDTLMI<br>SRTPEVTCVVVDVS<br>HEDPEVKFNWYVD<br>GVEVHNAKTKPREE<br>QYNSTYRVVSVLTV<br>LHQDWLNGKEYKC<br>KVSNKALPAPIEKTI<br>SKAKGQPREPQVYT<br>LPPCRDELTKNQVS<br>LWCLVKGFYPSDIA<br>VEWESNGQPENNY<br>KTTPPVLDSDGSFF<br>LYSKLTVDKSRWQQ<br>GNVFSCSVMHEALH<br>NHYTQKSLSLSPG | KPKDTLMISRTPEVTC<br>VVVDVSHEDPEVKFN<br>WYVDGVEVHNAKTKP<br>REEQYNSTYRVVSVL<br>TVLHQDWLNGKEYKC<br>KVSNKALPAPIEKTISK<br>AKGQPREPQVCTLPP<br>SRDELTKNQVSLSCA<br>VKGFYPSDIAVEWES<br>NGQPENNYKTTPPVL<br>DSDGSFFLVSKLTVDK<br>SRWQQGNVFSCSVM<br>HEALHNRFTQKSLSLS<br>PG | PVTKSFNRGEC |
| Y61 | EIVLTQSPATLS<br>LSPGERATLSC<br>RASQSVSSYLA<br>WYQEKPGQAP<br>RLLIYDASNRAT<br>GIPARFSGSGS<br>GTDFTLTISSLE<br>PEDFAVYYCQQ<br>SSNWPRTFGQ<br>GTKVEIKRTVAA<br>PSVFIFPPSDEQ<br>LKSGTASVVCLL<br>NNFYPREAKVQ<br>WKVDNALQSGN<br>SQESVTEQDSK<br>DSTYSLRSTLTL<br>SKADYEKHKVY<br>ACEVTHQGLSS<br>PVTKSFNRGEC | QVQLVESGGGVVQ<br>PGRSLRLDCKASGI<br>TFSNSGMHWVRKA<br>PGKGLEWVAVIWYD<br>GSKRYYADSVKGRF<br>TISRDNSKNTLFLQ<br>MNSLRAEDTAVYYC<br>ATNDDYWGQGTLV<br>TVSSASTKGPSVFP<br>LAPSSKSTSGGTAA<br>LGCEVKDYFPEPVT<br>VSWNSGALTSGVH<br>TFPAVLQSSGLYSL<br>SSVVTVPSSSLGTQ<br>TYICNVNHKPSNTK<br>VDKKVEPKSCDKTH<br>TCPPCPAPELLGGP<br>SVFLFPPKPKDTLMI<br>SRTPEVTCVVVDVS<br>HEDPEVKFNWYVD<br>GVEVHNAKTKPREE<br>QYNSTYRVVSVLTV<br>LHQDWLNGKEYKC<br>KVSNKALPAPIEKTI<br>SKAKGQPREPQVYT<br>LPPCRDELTKNQVS<br>LWCLVKGFYPSDIA<br>VEWESNGQPENNY<br>KTTPPVLDSDGSFF<br>LYSKLTVDKSRWQQ<br>GNVFSCSVMHEALH<br>NHYTQKSLSLSPG | EVQLVQSGAEVKKPG<br>ASVKVSCKASGYTFT<br>DSYMSWVREAPGQG<br>LEWIGDMYPDNGDSS<br>YNQKFRERVTITRDTS<br>TSTAYLELSSLRSEDT<br>AVYYCVLAPRWYFSV<br>WGQGTLVTVSSASTK<br>GPSVFPLAPSSKSTS<br>GGTAALGCRVKDYFP<br>EPVTVSWNSGALTSG<br>VHTFPAVLQSSGLYSL<br>SSVVTVPSSSLGTQTY<br>ICNVNHKPSNTKVDEK<br>VEPDSCDKTHTCPPC<br>PAPELLGGPSVFLFPP<br>KPKDTLMISRTPEVTC<br>VVVDVSHEDPEVKFN<br>WYVDGVEVHNAKTKP<br>REEQYNSTYRVVSVL<br>TVLHQDWLNGKEYKC<br>KVSNKALPAPIEKTISK<br>AKGQPREPQVCTLPP<br>SRDELTKNQVSLSCA<br>VKGFYPSDIAVEWES<br>NGQPENNYKTTPPVL<br>DSDGSFFLVSKLTVDK<br>SRWQQGNVFSCSVM<br>HEALHNRFTQKSLSLS<br>PG | DIQMTQSPSSLSA<br>SVGDRVTITCRAS<br>QDISNYLNWYQK<br>KPGKAPKLLIYYTS<br>RLRSGVPSRFSG<br>SGSGTDFTLTISSL<br>QPEDFATYYCQQ<br>GHTLPPTFGQGT<br>KVEIKRTVAAPSV<br>FIFPPSKKQLKSG<br>TASVVCLLNNFYP<br>REAKVQWKVDNA<br>LQSGNSQESVTE<br>QDSKDSTYSLEST<br>LTLSKADYEKHKV<br>YACEVTHQGLSS<br>PVTKSFNRGEC |

Example 2: Heterodimerization Enabling Mutations in the CODV Format

Three different mutants of the CODV antibody format were explored for expression, yield and homogeneity. The first format comprised a CODV antibody with knob-in-hole mutations in the Fc domain with the CH1/kappa MUT4 mutations in the CODV-Fab (CH1: L143Q, S188V; Ck: V133T, S176V) and the CH1/kappa CR3 mutations in Fab2 (CH1: T192E; Ck: N137K, S114A) (FIG. 1A). The second format comprised a CODV antibody with knob-in-hHole mutations in the Fc domain with the MUT4/CR3 mutations of the first format, in combination with electrostatic mutations VH39ENL38K in both CODV-Fabs and Fab2 (FIG. 1B). The third format comprised a CODV antibody with Knob-in-Hole mutations in the Fc domain with the MUT4/CR3 mutations and electrostatic mutations of the second format, in combination with disulfide stabilizing mutations VH44C/VL1000 on the CODV-Fab (FIG. 1C).

A summary of the electrostatic and disulfide bond-forming mutations in the variable regions is shown in Table 4. A summary of the CH1/CL kappa mutations is shown in Table 5. The detailed description of the expression and purification schemes are described in Example 1. FIG. 2A-FIG. 2G graphically depict data from the various CODV antibody formats tested.

Table 5 below summarizes the results of the characterization of various CODV antibody formats tested on a ([OX40×PD1]+GITR) trispecific CODV antibody. CH1/Ck mutations: CODV-Fab (CH1: L143Q, S188V; Ck: V133T, S176V) and Fab (CH1: T192E; Ck: N137K, S114A). CM (charged mutations): CODV-Fab (VH39ENL38K) and Fab2 (VH39K/VL38E). ds (disulfide bond stabilizing mutations): VH44CysNL100Cys. As shown below in Table 5, the introduction of mutations within the CH1/CL interface increased the onset melting point (Tm onset), indicating an increase in thermal stability. Further incorporation of VHNL modifications significantly increased the correct pairing as shown by HIC and MS (see FIG. 2A-FIG. 2G). The combination of CH1/CL kappa mutation sets (CR3 and MUT4) and disulfide stabilizing mutations showed promising results, demonstrating high HIC monomer content and increased thermostability. The combination of CH1/CL kappa mutation sets (CR3 and MUT4), disulfide stabilizing mutations, and opposite charge mutations also showed promising results.

TABLE 5

Summary of expression and biophysical characterization of an ([OX40 x PD1] + GITR) trispecific CODV antibody containing different Fab interface mutations.

| clone | Yield [mg/L] | SEC Monomer [%] | HIC [% monomer] | MS [correctly paired] [mispared] | Tm onset Average Tm1 Average Tm2 [° C.] |
|---|---|---|---|---|---|
| Wild type C1 | 53 | 76 | 32 | LC2 + HC1<br>LC2 + HC2<br>LC1 + HC1<br>LC2 + HC2<br>LC1 + HC1<br>LC1 + HC2 | 51<br>62<br>68 |
| CH1/Ck mutations C2 | 89 | 86 | 34 | LC2 + HC1<br>LC2 + HC2<br>LC1 + HC1<br>LC2 + HC2 | 55<br>65<br>84 |
| CH1/Ck + CM C3 | 124 | 81 | 18 | LC2 + HC1<br>LC2 + HC2<br>LC1 + HC1<br>LC2 + HC2 | 52<br>58<br>79 |
| ds C4 | 22 | 73 | 81 | LC1 + HC1<br>LC2 + HC2<br>LC1 + HC1 + LC2<br>LC2 + HC2 | |
| CH1/Ck + ds C5 | 32 | 84 | 98 | LC1 + HC1<br>LC2 + HC2<br>Homodimer<br>LC2 + HC2 | |
| CM + Ds C6 | 23 | 79 | 88 | LC1 + HC1<br>LC2 + HC2<br>LC2 + HC1<br>LC2 + HC2 | |
| CH1/Ck + CM ds C7 | 57 | 89 | 98 | LC1 + HC1<br>LC2 + HC2 | 60<br>63<br>80 |

Example 3: Heterodimerization Enabling Mutations in the Tandem Fab Format

Two conformations of tandem Fab antibodies were explored. Each conformation was further tested for efficient expression, purification and homogeneity. The first format consisted of an open conformation of the tandem Fab where a Y-shaped antibody is attached, through flexible linkers on the VH domain, to another Fab fragment (see FIG. 3A and FIG. 3B). The second tandem Fab consisted of a closed conformation of the tandem fab where the linkers in the VH domain described above could form a disulfide bond (see FIG. 3C and FIG. 3D).

Figure 3A:
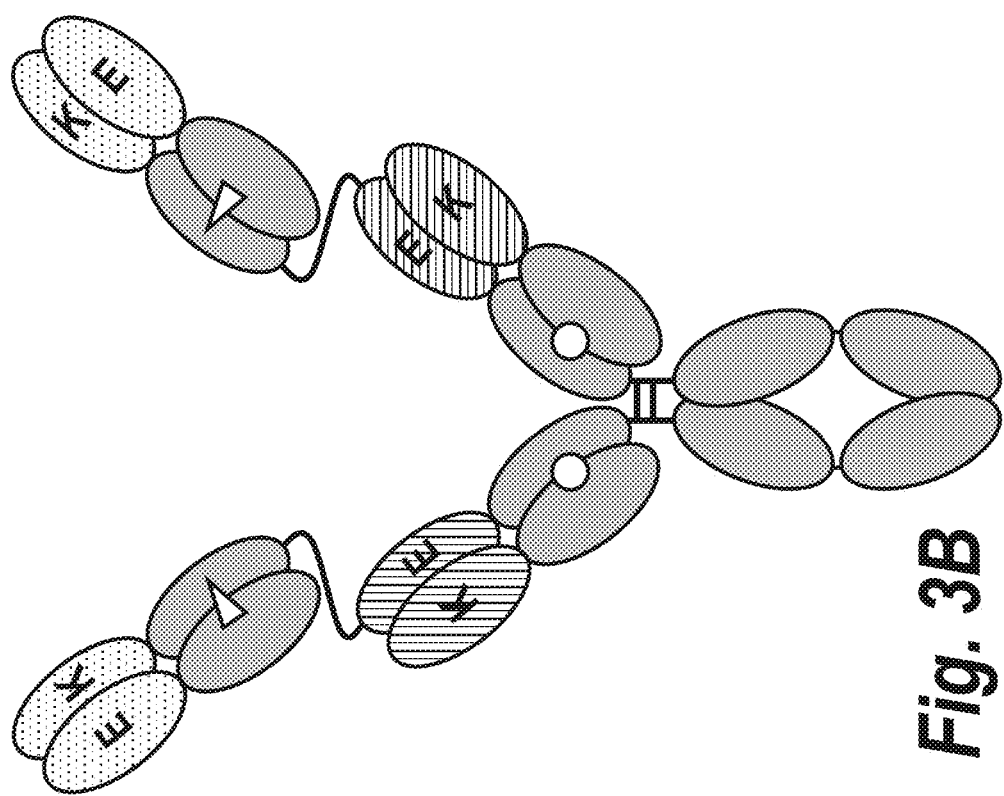
FIG. 3A-FIG. 3D schematically depict tandem Fabs antibody formats in open (FIG. 3A, FIG. 3B) and closed (FIG. 3C, FIG. 3D) configurations.
Figure 3B:
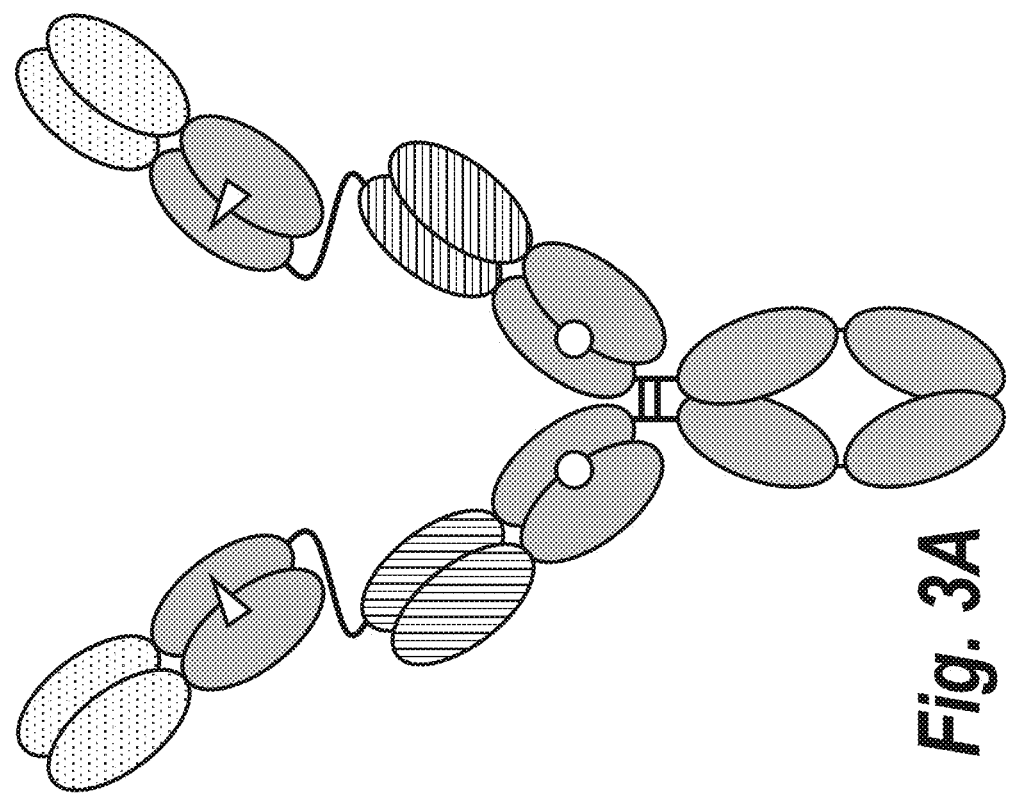

Two mutants, one for each of the open-tandem Fab and closed-tandem Fab conformations, were explored for efficient expression, purification and homogeneity. The first mutant consisted of an open fab with only the MUT4 and CR3 mutations (FIG. 3A). The second mutant consisted of an open fab with the MUT4 and CR3 mutations in combination with the opposite charged mutations (FIG. 3B).

Figure 3D:
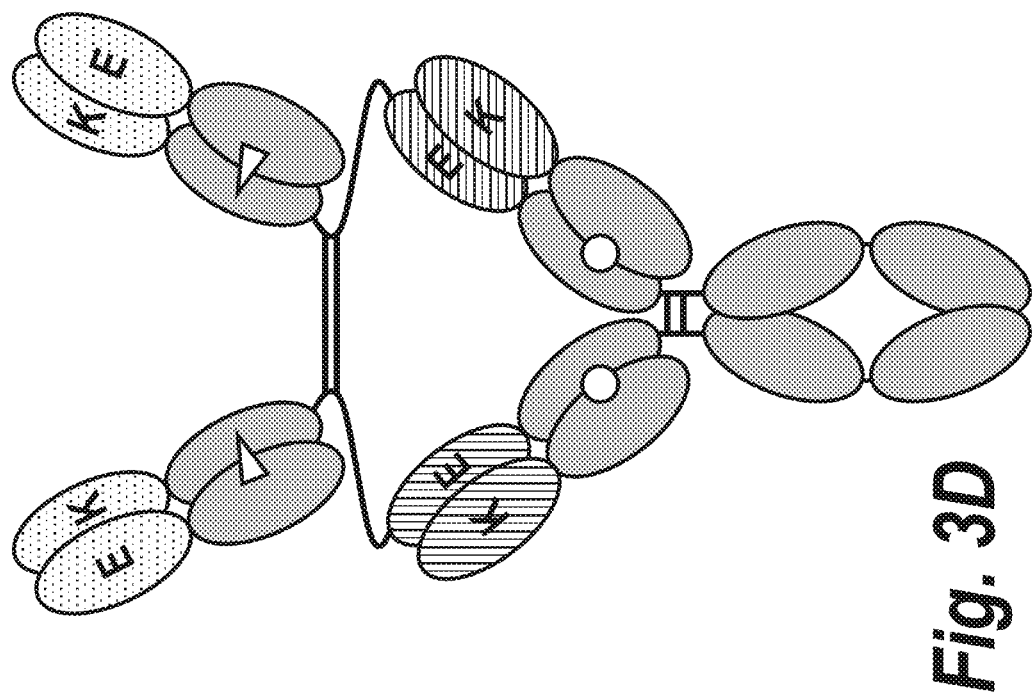
Figure 3C:
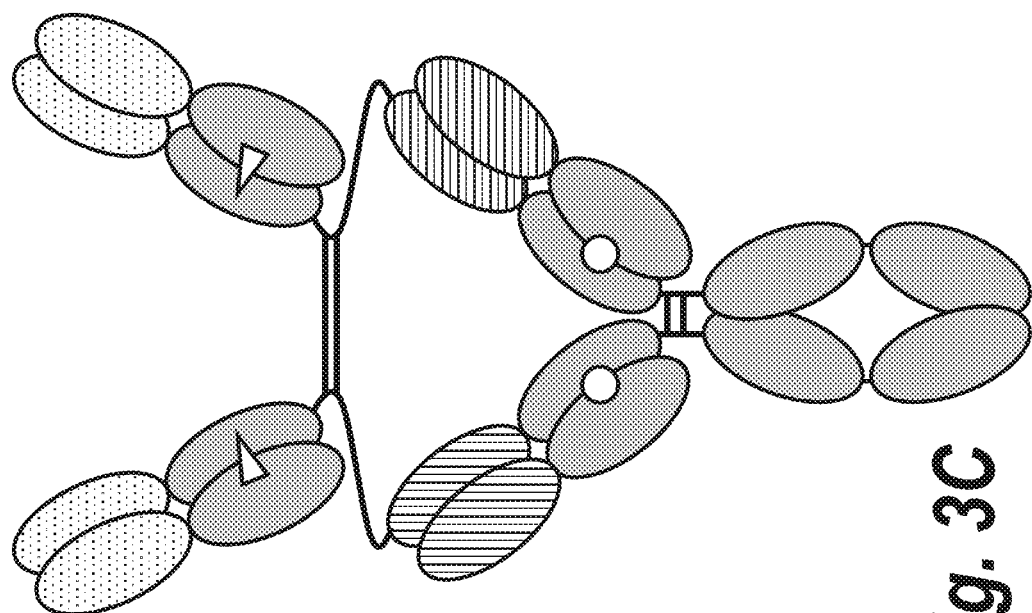

Two mutants, each of the closed-tandem Fab conformation, were explored for efficient expression, purification and homogeneity. The first mutant consisted of a closed fab with only the MUT4 and CR3 mutations (FIG. 3C). The second mutant consisted of a closed fab with the MUT4 and CR3 mutations in combination with the opposite charged mutations (FIG. 3D).

As shown in Table 6 below, a combination of CH1/CL with VH/VL interface mutations increased the target HIC profile in comparison to the examples where only the CH1/CL modifications were introduced. Thus, the combinatorial mutations decreased the amount of incorrectly paired species and increased the amount of correct paired molecules (target HIC peak). The strength of the pairing results was dependent from the antibody sequence and domain alignment.

TABLE 6

Yield, SEC, HIC, and binding affinity data for tandem Fab antibodies.

| ID | yield [mg/L] | SEC Monomer [%] | HIC Main peak [%] | Affinity |
|---|---|---|---|---|
| T1 | 47.15 | 100 | 65 | n.m. |
| T2 | 0.54 | 84 | n.m. | n.m. |
| T3 | 45.47 | 97 | 70 | GITR 0.3 nM<br>OX40 0.3 nM |
| T4 | 49.98 | 45 | 87 | OX40 0.2 nM<br>GITR 0.9 nM |
| T5 | 48.2 | 44 | 93 | OX40 0.2 nM<br>GITR 0.7 nM |
| T6 | 15.54 | 100 | 95 | GITR 0.5 nM<br>OX40 n.b. |
| T7 | 58.7 | 100 | 93 | GITR 0.7 nM<br>OX40 1 nM |
| T8 | 15 | 100 | 57 | OX40 0.3 nM<br>GITR 0.6 nM |
| T9 | 1.96 | 85 | 7658 | OX40 0.2 nM<br>GITR 0.6 nM |
| T10 | 57.5 | 99 | 68 | n.m. |
| T11 | 40.5 | 95 | n.e. | GITR n.m.<br>OX40 0.2 nM |
| T12 | 33.4 | 91 | 67 | n.m. |
| T13 | 25.5 | 96 | n.e. | CD40 2.4 nM<br>PD-L1 93 pM |
| T14 | 34.1 | 95 | 88 | PD-L1 19 pM<br>CD40 2.4 nM |
| T15 | 57.1 | 100 | 68 | OX40 0.08 nM<br>PD1 0.6 nM |
| T16 | 71.04 | 100 | 95 | PD-L1 21 pM<br>CD40 4 nM |
| T17 | 63.2 | 100 | 10 | CD40 3.1 nM<br>PD-L1 72 pM |

TABLE 6-continued

Yield, SEC, HIC, and binding affinity data for tandem Fab antibodies.

| ID | yield [mg/L] | SEC Monomer [%] | HIC Main peak [%] | Affinity |
|---|---|---|---|---|
| T18 | 45.96 | 99 | 92 | PD-L1 23 pM CD40 2.1 nM |
| T19 | 42.8 | 44 | 47 | PD1 0.2 nM OX40 0.2 nM |
| T20 | 37.2 | 49 | 56 | PD1 0.2 nM OX40 0.3 nM |
| T21 | 0.0 | n.m. | n.m. | OX40 0.2 nM PD1 0.9 nM |
| T22 | 50.6 | 71 | 62 | CD40 1.7 nM PD-L1 58 pM |
| T23 | 55.8 | 99 | 98 | PD1 0.2 nM OX40 0.3 nM |
| T24 | 67.92 | 99 | 98 | PD1 0.2 nM OX40 0.5 nM |
| T25 | 59.64 | 99 | 95 | OX40 0.2 nM PD1 1.5 nM |
| T26 | 66.6 | 99 | 92 | CD40 1.6 nM PD-L1 51 pM |

Figure 4:
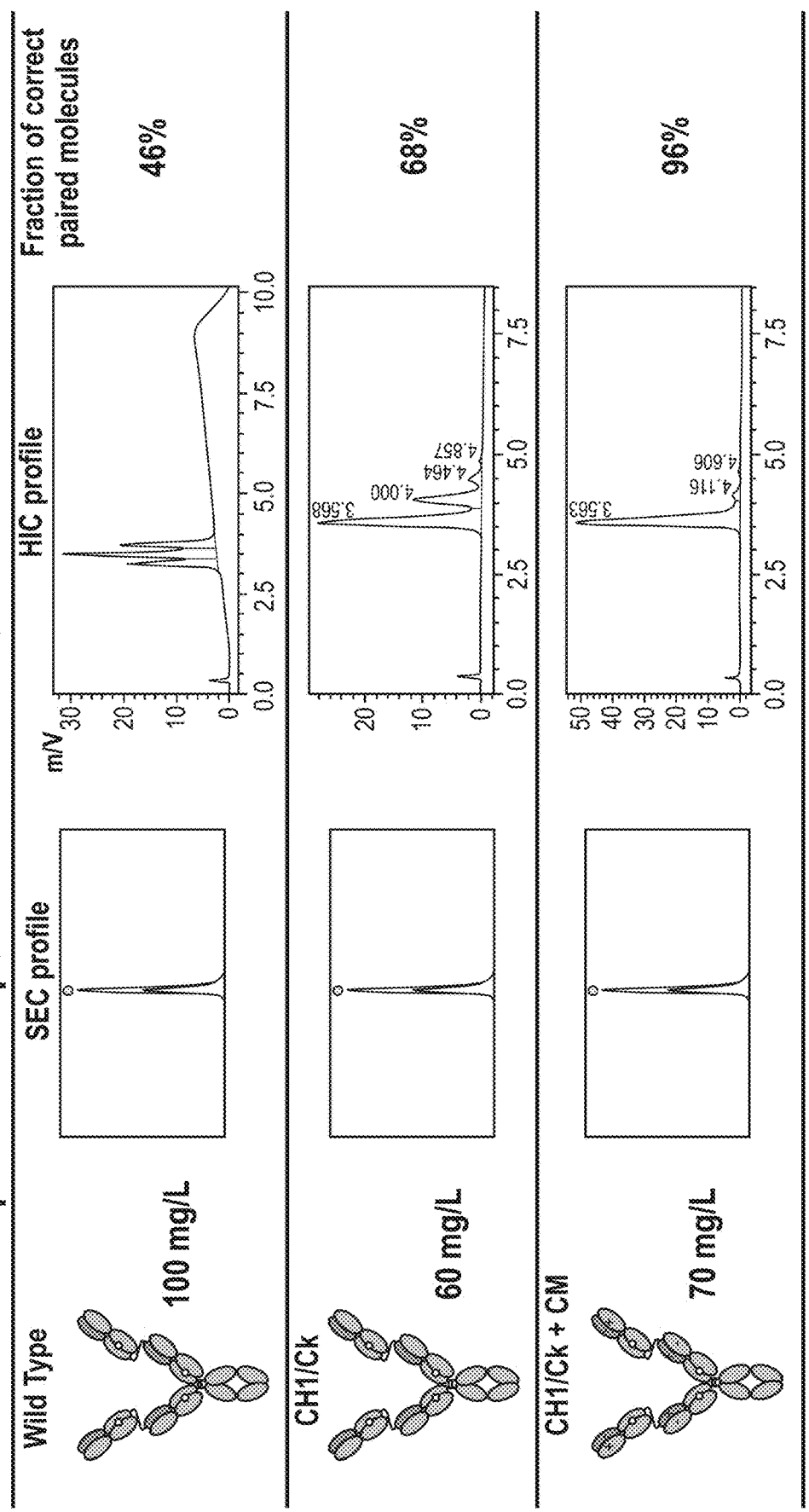
FIG. 4 depicts the results of SEC and HIC analysis for tandem Fabs in the open configuration in WT, CH1/Ck, and CH1/Ck+CM formats.
Figure 5C:
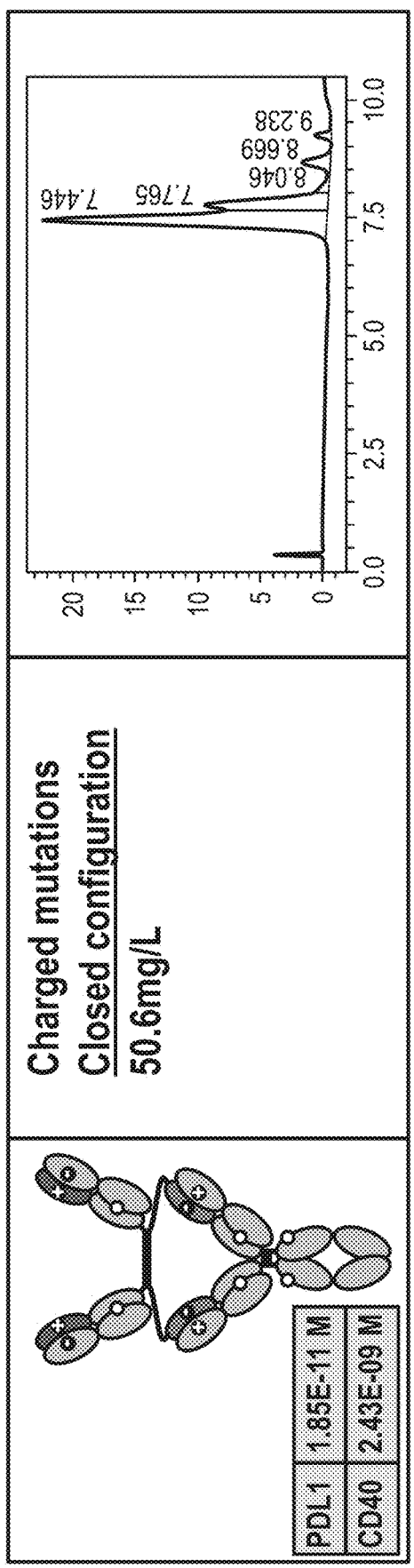
Figure 5D:
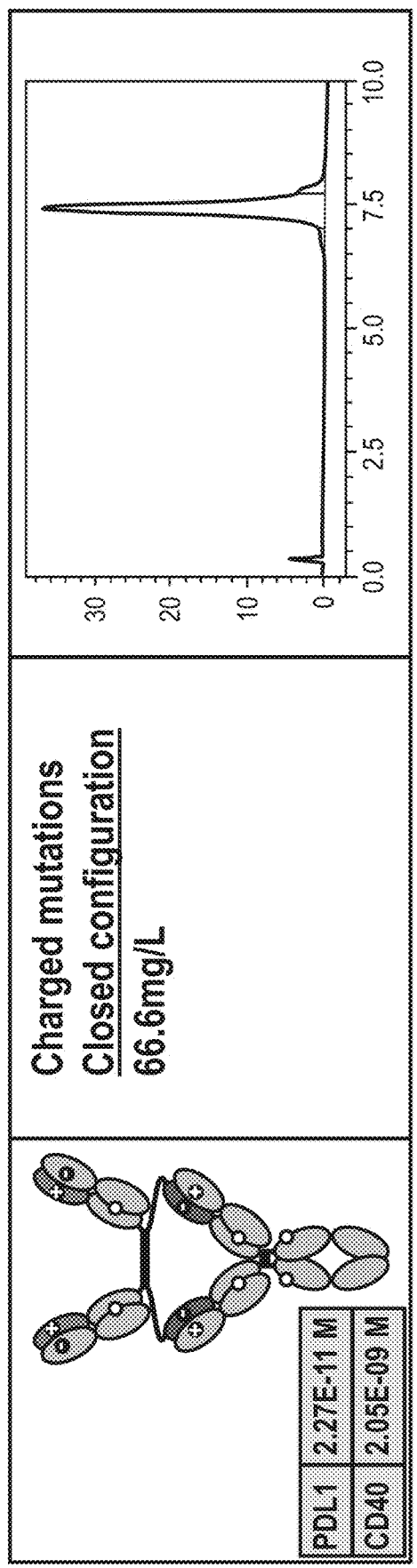

The open configuration tandem Fab with only the MUT4/CR3 mutations yielded approximately 68% correct pairing. However, it was observed that introduction of the opposite charged mutations increased the yield and homogeneity of the correct polypeptide from 68% to 96% (FIG. 4).

Figure 6C:
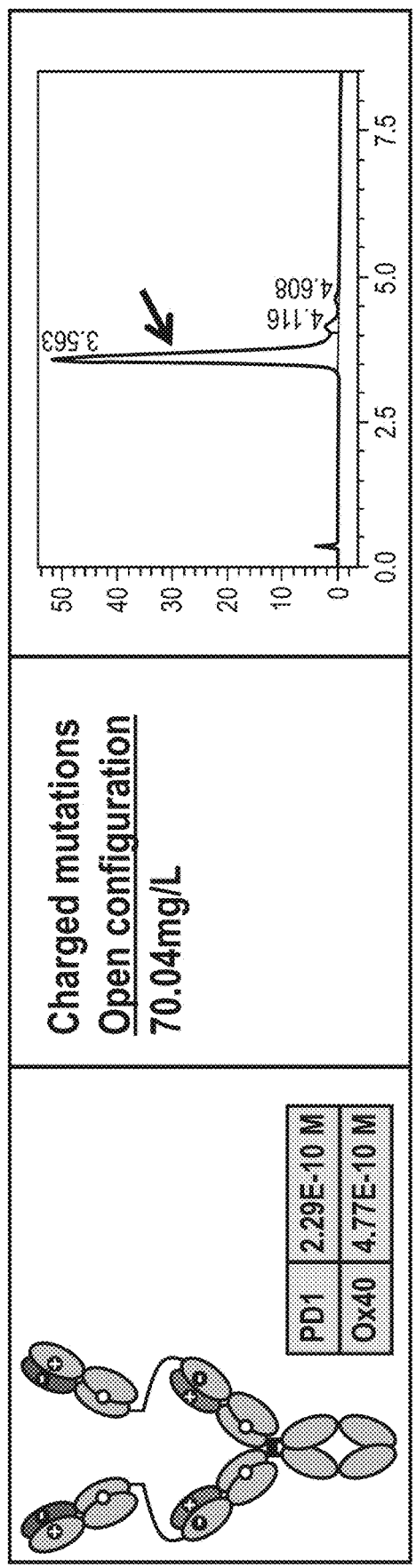
Figure 7A:
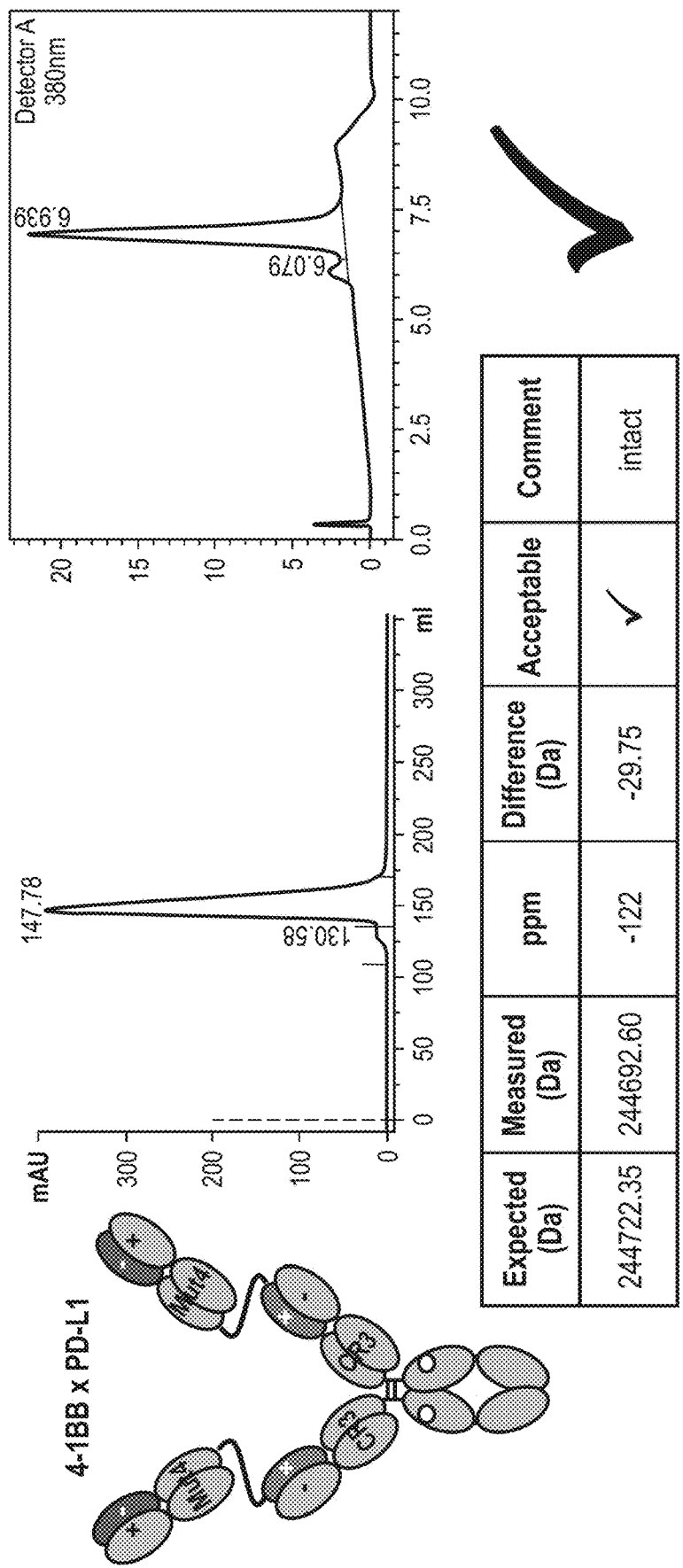
FIG. 7A-FIG. 7B depict purity results for an anti-4-1BB×anti-PD-L1 tandem Fab antibody (FIG. 7A) and an anti-4-1BB×anti-PD-1 tandem Fab antibody (FIG. 7B). Both antibodies are in the open configuration with CH1/Ck and CM mutations.
Figure 7B:
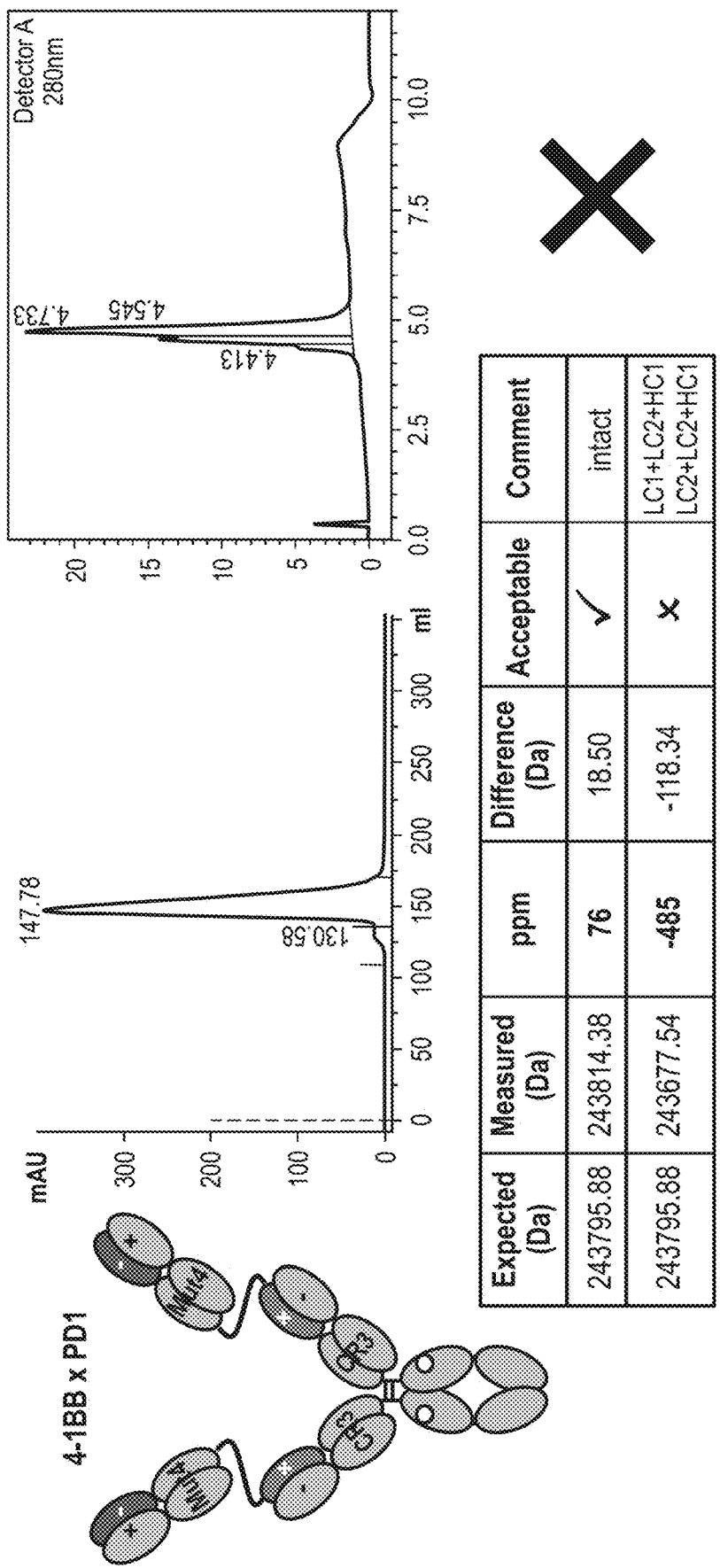

The open and closed configurations were compared side-by-side with an anti-CD40×anti-PD-L1 antibody. As can be seen in FIG. 5A-FIG. 5D, the closed configuration resulted in lower yield and purity, as measured by HIC, compared to the open configuration. The addition of the opposite charged mutations combined with the CH1/CL kappa mutations (CR3/MUT4) improved purity as well. These effects were supported by the anti-PD-1×anti-OX40 antibody, as shown in FIG. 6A-FIG. 6C. The open configuration resulted in higher yield and purity. The inclusion of the opposite charge mutations further improved yield and purity.

Example 4: Y-Shaped Antibody Mutations

Orthogonal Fab design in bispecific antibodies with Y-shaped architecture was achieved by introduction of knobs-into-holes mutations (knob: S354C, T366W; hole: Y349C, T366S, L368A, Y407V) into the CH3 domains of the respective heavy chains.

Figure 8B:
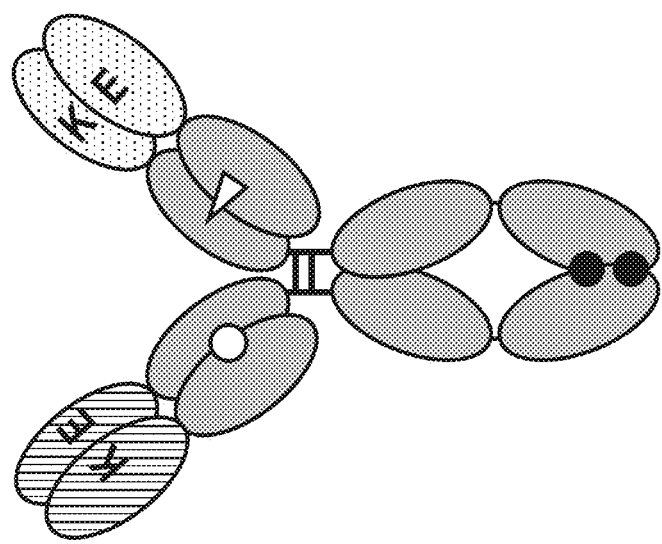
FIG. 8A-FIG. 8B schematically depict Y shaped bispecific antibody formats with several different mutations to enhance heterodimerization.
Figure 8A:
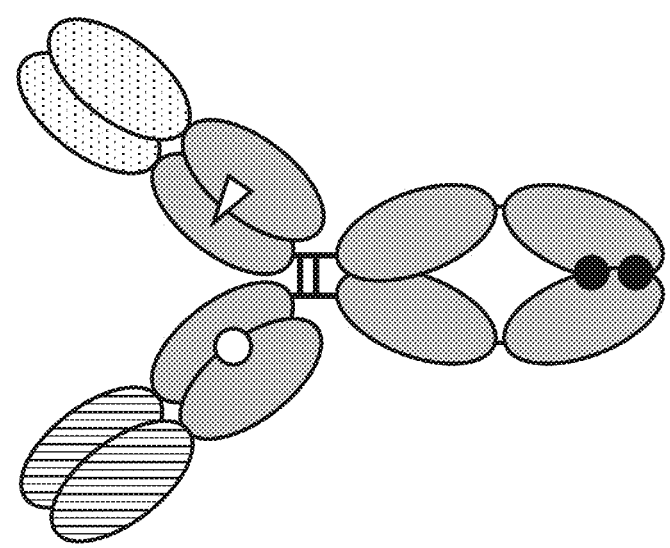

The two different Fab arms contained the mutations described in FIG. 8A and FIG. 8B, as well as the mutations shown in Tables 7-9 below. The mutations in FIG. 8A are the CH1/kappa MUT4 mutations in Fab1 (CH1: L143Q, S188V; Ck: V133T, S176V) and the CH1/kappa CR3 mutations in Fab2 (CH1: T192E; Ck: N137K, S114A). The mutations in FIG. 8B are the MUT4/CR3 mutations of FIG. 8A, in combination with electrostatic mutations VH39E/VL38K in both Fab1 and Fab2.

Figure 9B:
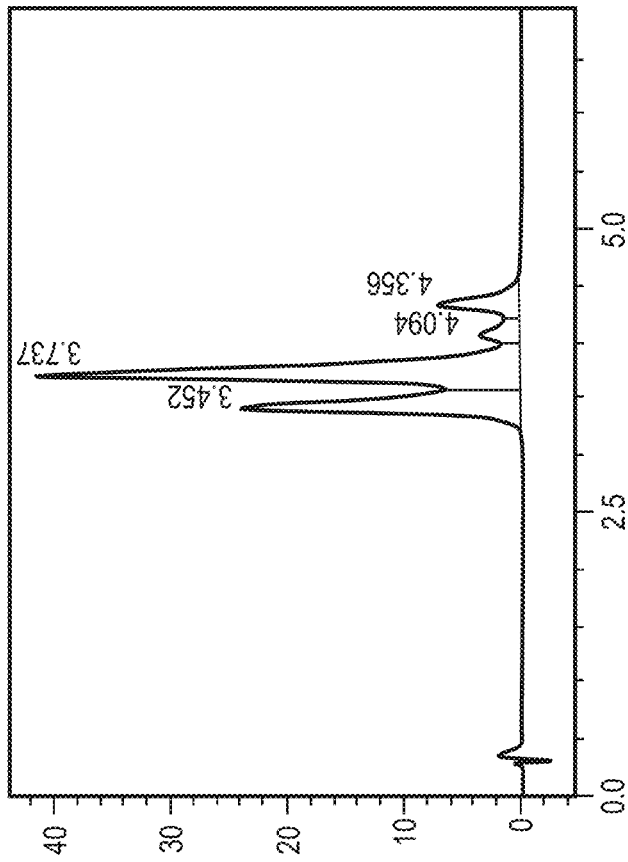
FIG. 9A-FIG. 9C depicts purity results for an anti-PD-1×anti-OX40 antibody. NanoDSF (differential scanning fluorimetry) was used to measure thermal stability of the antibodies for T onset. HIC was used to measure purity. Wild-type antibody is shown in FIG. 9A. CH1/Ck mutations (Fab1=CH1: L143Q, S188V; Ck: V133T, S176V) and (Fab2=CH1: T192E; Ck: N137K, S114A) are shown in FIG. 9B. CH1/Ck and CM mutations (Fab1=CH1: L143Q, S188V; Ck: V133T, S176V; VH39ENL38K) and (Fab2=CH1: T192E; Ck: N137K, S114A; VH39KVL38E) are shown in FIG. 9C.
Figure 9A:
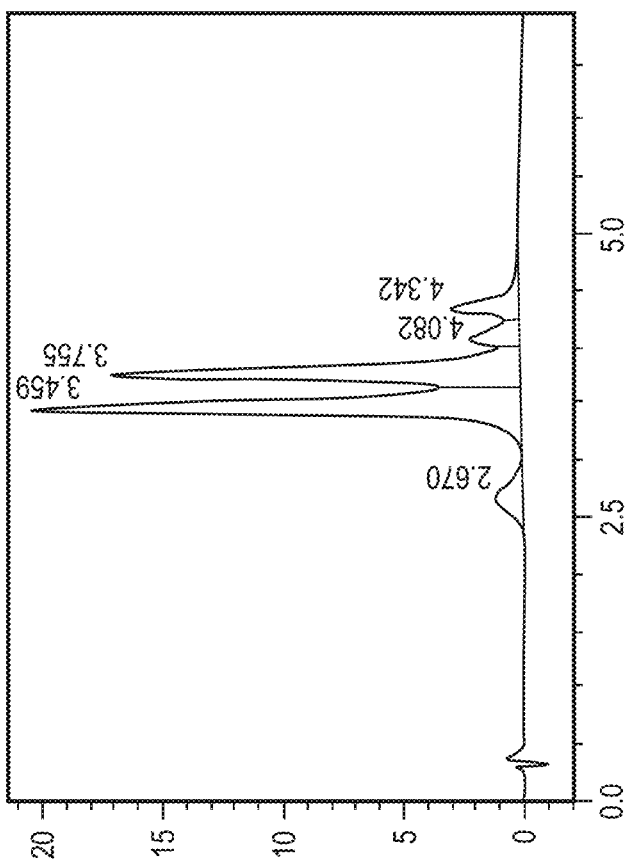
Figure 9C:
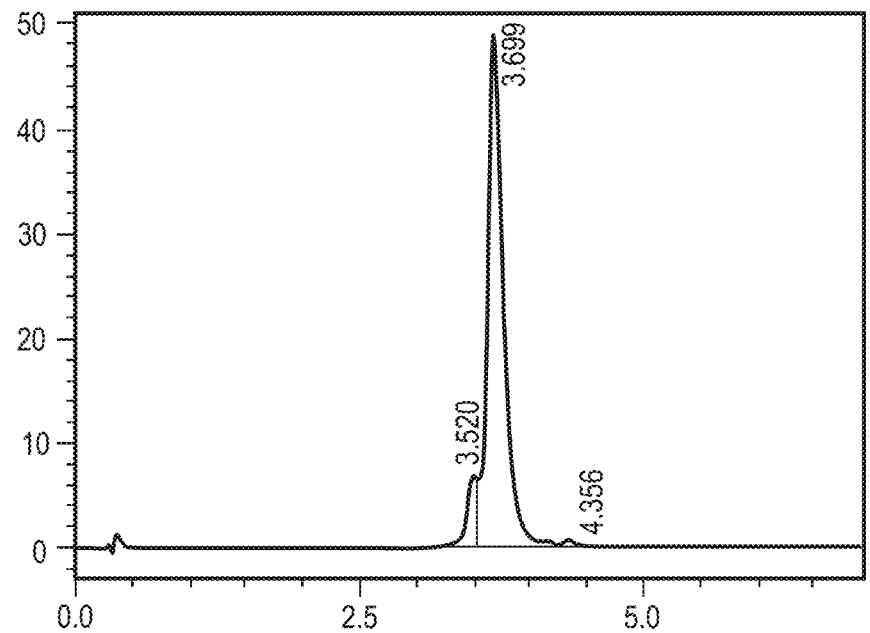
Figure 10A:
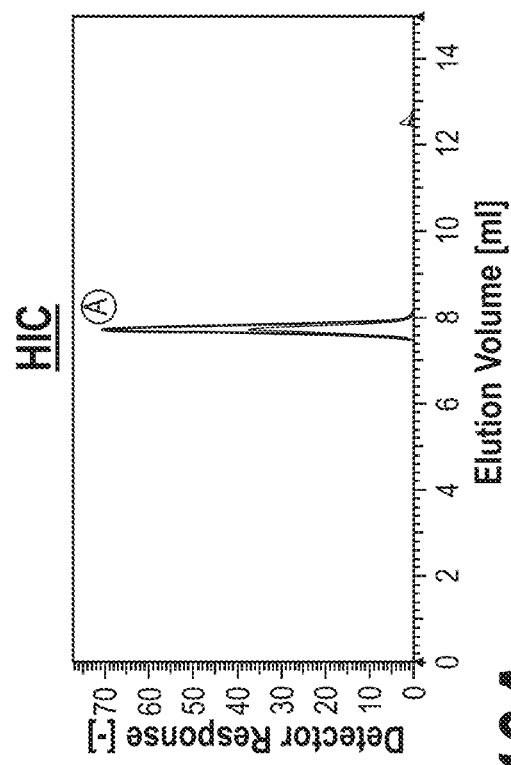
Figure 10A:
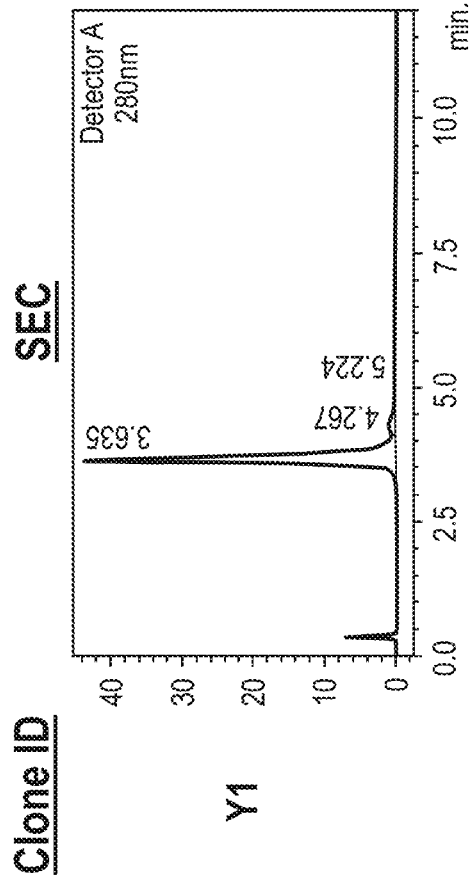
Figure 10B:
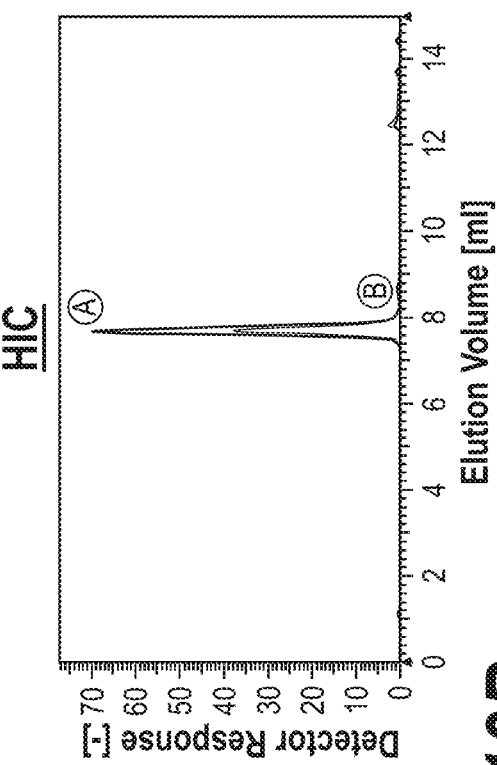
Figure 10B:
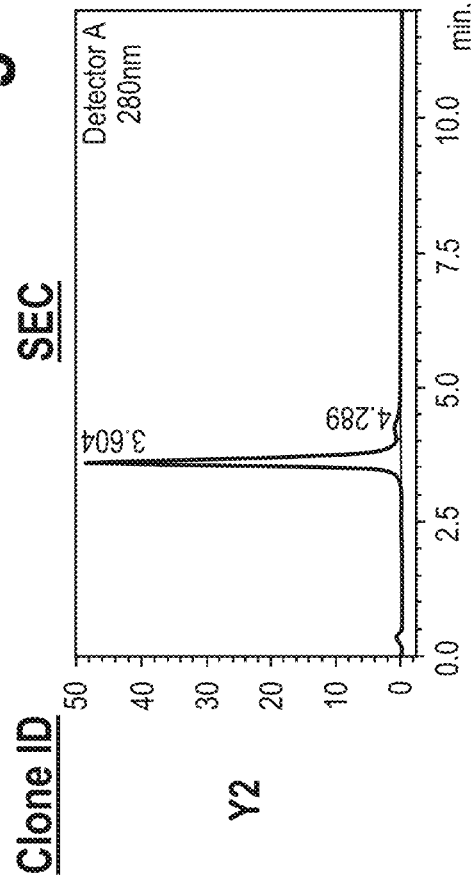
Figure 10C:
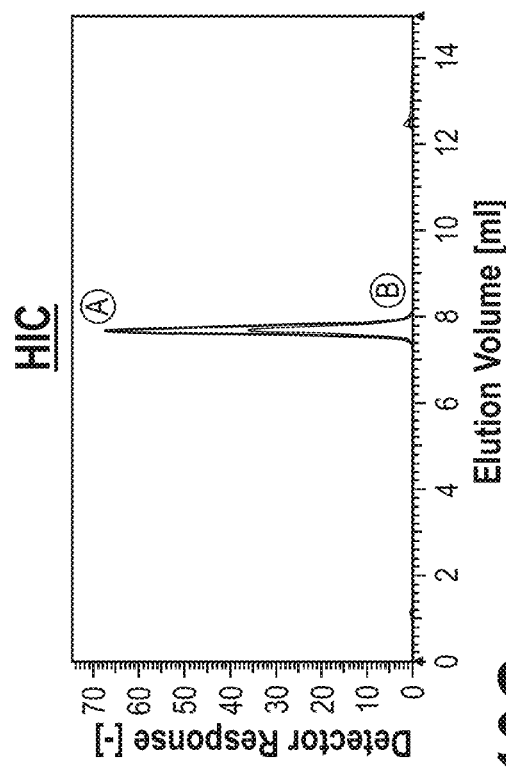
Figure 10C:
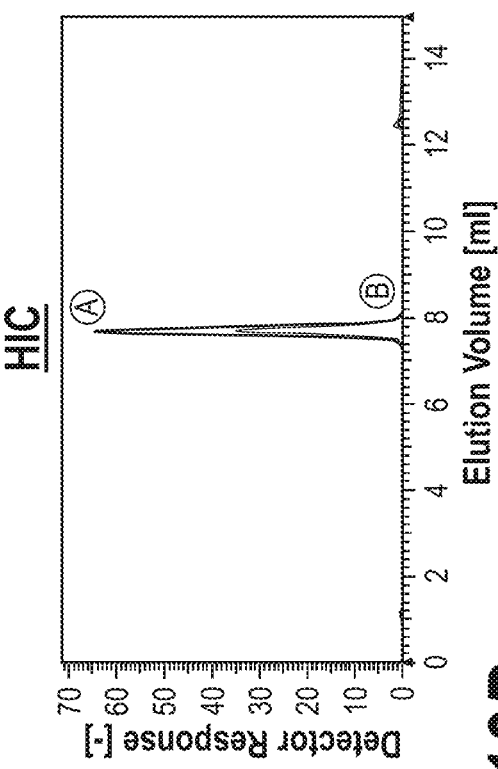
Figure 10C:
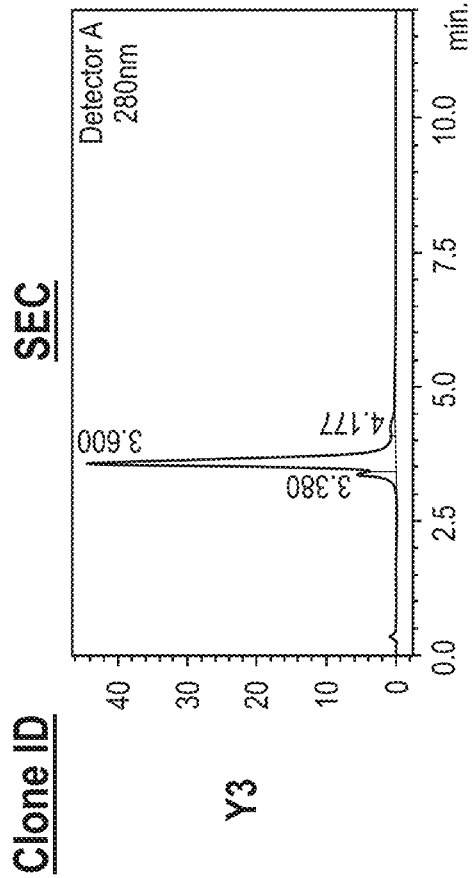
Figure 10D:
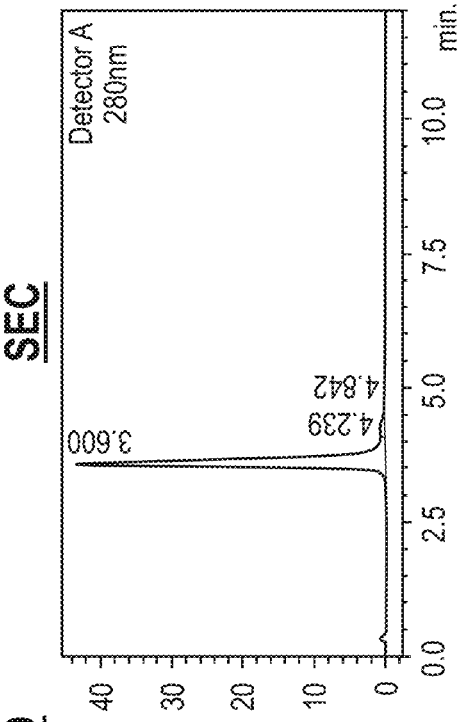
Figure 10G:
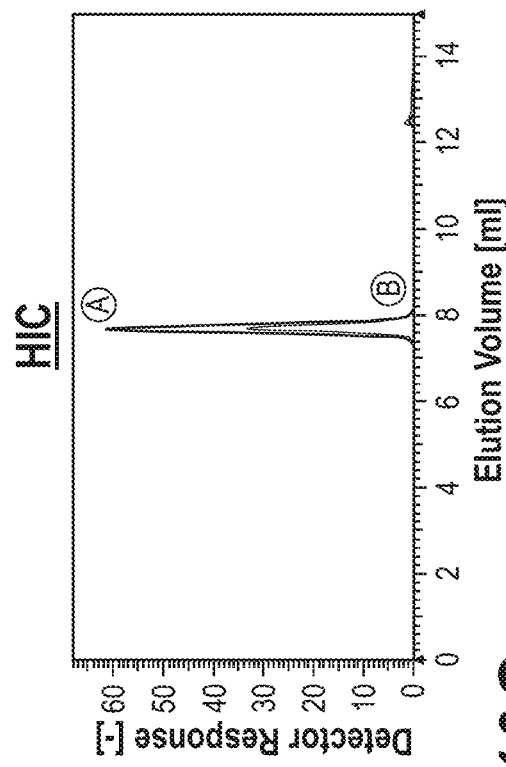
Figure 10G:
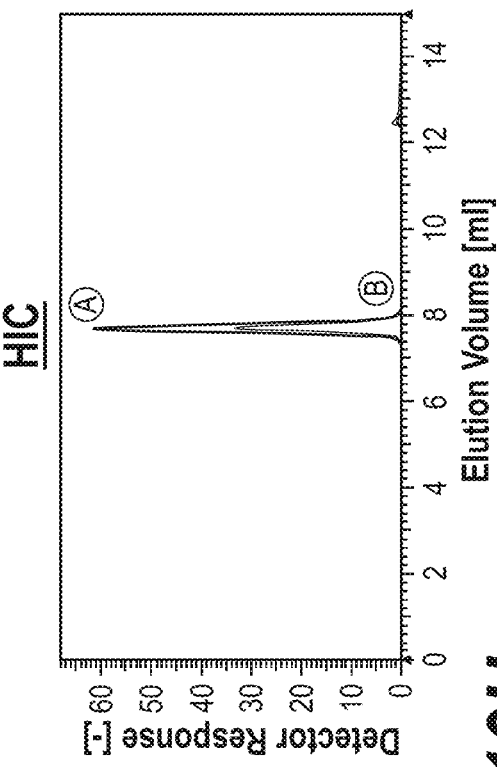
Figure 10H:
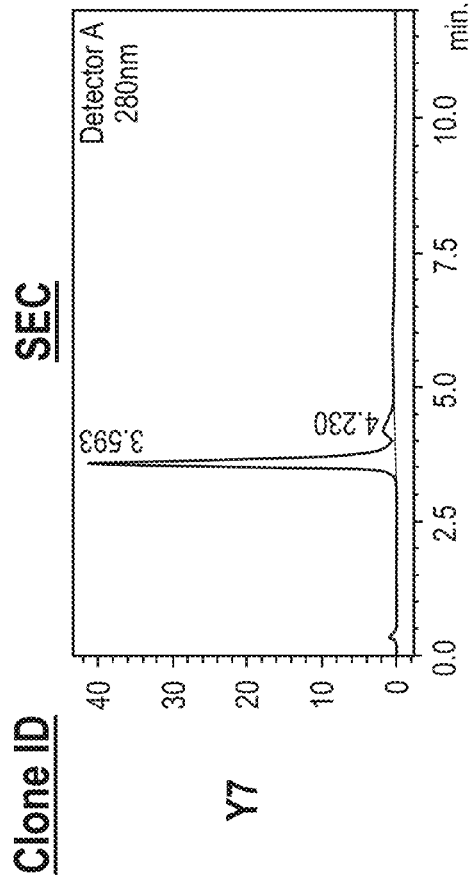
Figure 10H:
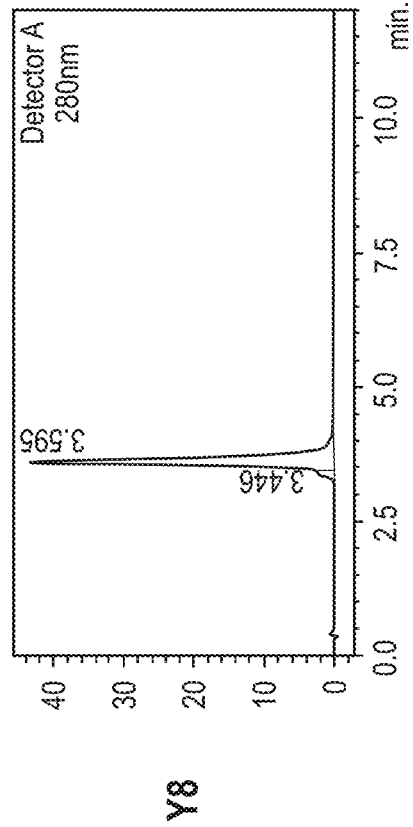
Figure 10I:
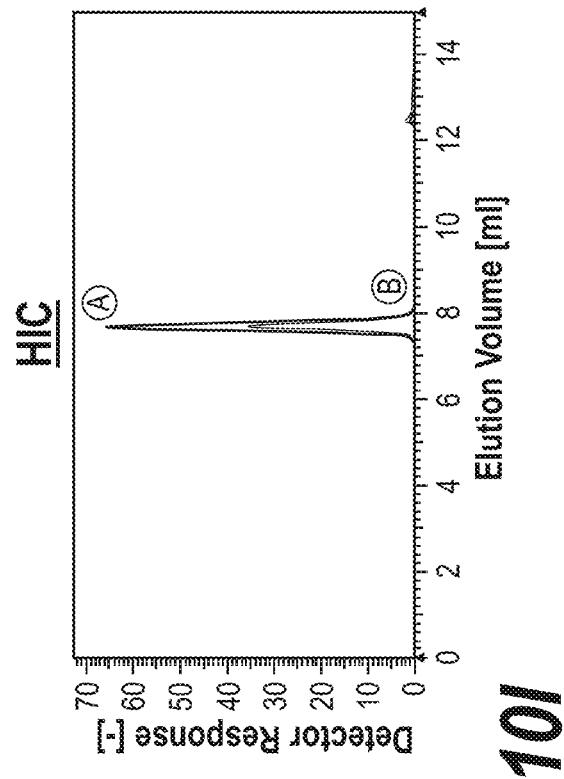
Figure 10I:
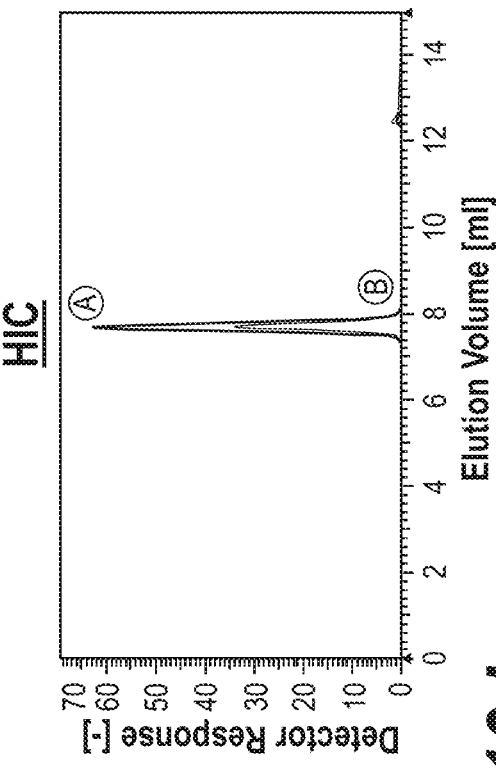
Figure 10J:
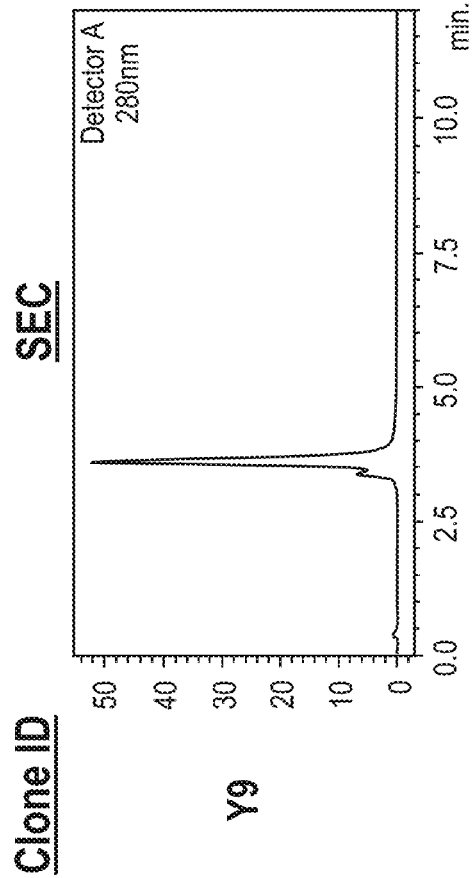
Figure 10J:
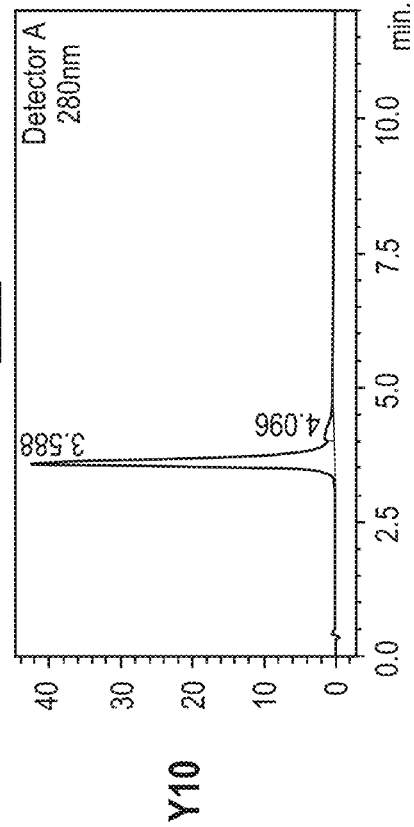
Figure 10K:
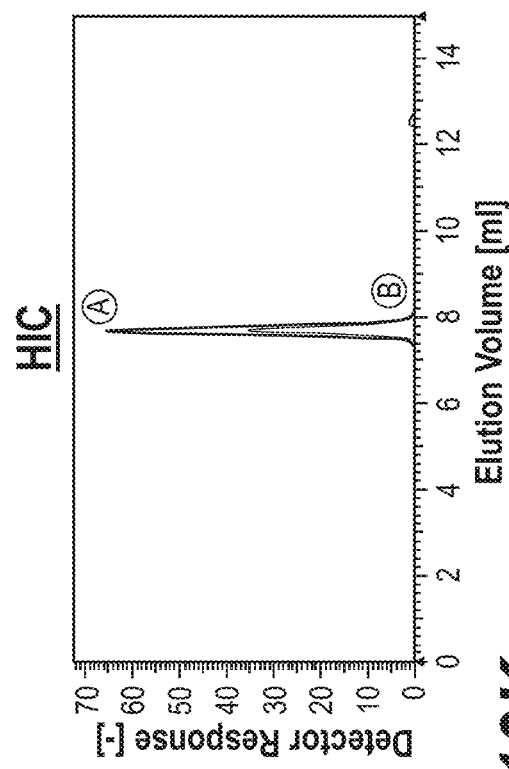
Figure 10K:
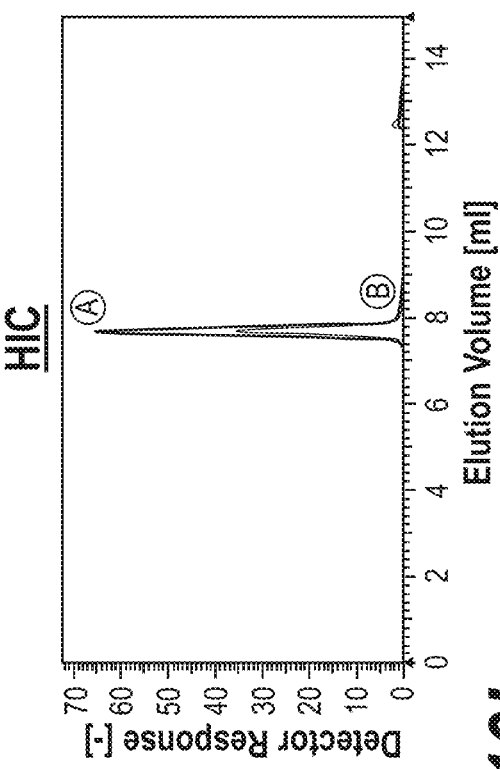
Figure 10L:
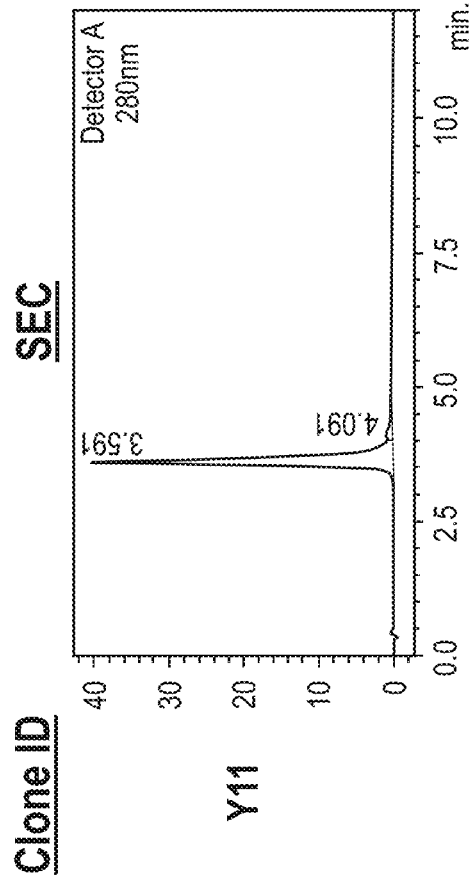
Figure 10L:
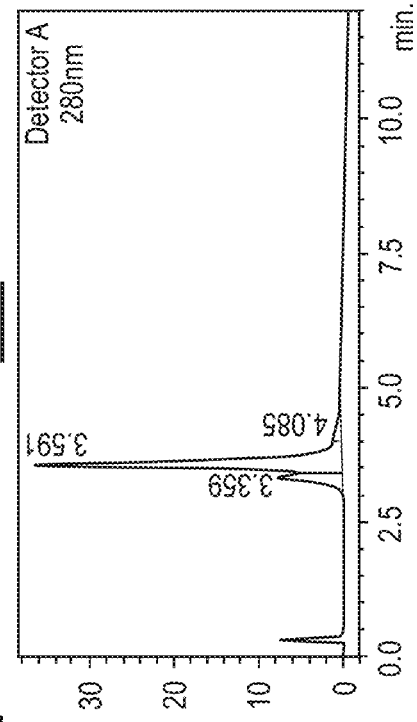

An anti-PD-1×anti-OX40 antibody with various mutations was tested. Table 7 below provides a summary of expression and biophysical characterization of variants of the PD-1×OX40 bispecific antibody varying in its Fab interface mutations. The CH1/CL-only or VH/VL-only modifications were not efficacious to prevent mispairing. The combination of the proposed CH1/CL mutations with VH39/VL38 interface mutations significantly influenced guided pairing as determined by HIC and MS (see FIG. 9A-FIG. 9C).

TABLE 7

Expression and biophysical characterization of variants of anti-PD-1 × anti-OX40 Y-shaped antibodies.

| Clone | Fab 1 (PD1) LC1 | Fab 1 (PD1) HC1 | Fab 2 (OX40) LC2 | Fab 2 (OX40) HC2 | Yield [mg/L] | SEC [% Monomer] | HIC [% target] | Onset Tm [° C.] | RU Ox40/RU Fc capture by SPR | RU PD1/RU Fc capture by SPR |
|---|---|---|---|---|---|---|---|---|---|---|
| Y13 | | | | | 54 | 96.5% | 36.8% | 60.2 | 5% | 24% |
| Y14 | V133T, S176V | L143Q, S188V | S114A, N137K | T192E | 60 | 100.0% | 55.1% | 59.3 | 8% | 21% |
| Y15 | Q38E | Q39K | Q38K | Q39E | 43 | 96.4% | 66.6% | 56.9 | 12% | 17% |
| Y16 | Q38E, V133T, S176V | Q39K, L143Q, S188V | Q38K, S114A, N137K | Q39E, T192E | 19 | 100.0% | 89.8% | 62.4 | 11% | 24% |
| Y17 | V133T, S176V | L143Q, S188V | | | 43 | 100.0% | 57.7% | 59 | 11% | 17% |
| Y18 | | | S114A, N137K | T192E | 57 | 90.2% | 28.9% | 59 | 4% | 27% |
| Y23 | E123K | K221E | | | 79 | 93.6% | 63.0% | 62.0 | 8% | 23% |
| Y24 | V133T, S176V | L143Q, S188V | E123K | K221E | 68 | 84.9% | 74.9% | 58.6 | 11% | 21% |
| Y25 | | | S114A, N137K, E123K | T192E, K221E | 63 | 98.6% | 52.9% | 58.4 | 7% | 25% |
| Y26 | V133T, S176V | L143Q, S188V | S114A, N137K, E123K | T192E, K221E | 61 | 93.2% | 74.7% | 59.0 | 10% | 22% |

TABLE 7-continued

Expression and biophysical characterization of variants of anti-PD-1 × anti-OX40 Y-shaped antibodies.

| Clone | Fab 1 (PD1) LC1 | Fab 1 (PD1) HC1 | Fab 2 (OX40) LC2 | Fab 2 (OX40) HC2 | Yield [mg/L] | SEC [% Monomer] | HIC [% target] | Onset Tm [° C.] | RU Ox40/RU Fc capture by SPR | RU PD1/RU Fc capture by SPR |
|---|---|---|---|---|---|---|---|---|---|---|
| Y27 | | | S114A, V133T, N137K, S176V | L143Q, T192E, S188V | 77 | 97% | 39.8% | 59.7 | 6% | 24% |
| Y33 | Q38E | Q39K | Q38K, E123K | Q39E, K221E | 74 | 98.2% | 95.7% | 62.5 | 12% | 24% |
| Y34 | Q38E, V133T, S176V | Q39K, L143Q, S188V | Q38K, E123K | Q39E, K221E | 71 | 95.4% | 94.9% | 62.0 | 12% | 24% |
| Y35 | Q38E | Q39K | Q38K, S114A, E123K, N137K | Q39E, T192E, K221E | 62 | 95.6% | 95.4% | 62.3 | 12% | 23% |
| Y36 | Q38E, V133T, S176V | Q39K, L143Q, S188V | Q38K, S114A, E123K, N137K | Q39E, T192E, K221E | 55 | 95.3% | 94.3% | 62.1 | 12% | 24% |
| Y37 | Q38E | Q39K | Q38K, S114A, V133T, N137K, S176V | Q39E, L143Q, S188V, T192E | 80 | 97.7% | 92.6% | 62.5 | 12% | 24% |

An ant-CD40×anti-PD-L1 antibody with various mutations was tested. Table 8 below provides a summary of expression and biophysical characterization of variants of the CD40×PD-L1 bispecific antibody varying in its Fab interface mutations. The OH1/CL-only or VHNL-only modifications were not efficacious to prevent mispairing. The combination of OH1/CL mutations VH39NL38 interface mutations significantly influenced guided pairing as determined by HIS and MS.

TABLE 8

Expression and biophysical characterization of variants of anti-CD40 × anti-PD-L1 Y-shaped antibodies.

| Clone | Fab 1 (CD40) LC1 | Fab 1 (CD40) HC1 | Fab 2 (PD-L1) LC2 | Fab 2 (PD-L1) HC2 | Yield [mg/L] | SEC [% Monomer] | HIC [% target] | Onset Tm [° C.] | RU CD40/RU Fc capture by SPR | RU PDL1/RU Fc capture by SPR |
|---|---|---|---|---|---|---|---|---|---|---|
| Y19 | | | | | 57 | 96.6% | 57.2% | 58.6 | 64% | 91% |
| Y20 | V133T S176V | L143Q S188V | S114A N137K | T192E | 81 | 95.8% | 62.3% | 57.7 | 63% | 91% |
| Y21 | Q38E | Q39K | Q38K | Q39E | 76 | 97.6% | 71.9% | 58.1 | 61% | 91% |
| Y22 | | | S114A N137K | T192E | 102 | 97.1% | 70.9% | 58.2 | 69% | 91% |
| Y28 | E123K | K221E | | | 37 | 100% | 62.1% | 57.13 | 65% | 92% |
| Y29 | V133T S176V | L143Q S188V | E123K | K221E | 112 | 98.4% | 65.5% | 58.27 | 65% | 92% |
| Y30 | | | S114A E123K N137K | T192E K221E | 57 | 100.0% | 69.5% | 57.27 | 74% | 91% |
| Y31 | V133T S176V | L143Q S188V | S114A E123K N137K | T192E K221E | 88 | 98.5% | 72.2% | 58.51 | 58% | 90% |
| Y32 | | | S114A V133T N137K S176V | L143Q T192E S188V | 53 | 99.1% | 73.7% | 58.66 | 61% | 90% |
| Y38 | Q38E | Q39K | Q38K, E123K | Q39E K221E | 79 | 100% | 100.0% | 58.72 | 64% | 89% |
| Y39 | Q38E V133T S176V | Q39K L143Q S188V | Q38K, E123K | Q39E K221E | 78 | 99% | 100.0% | 57.74 | 63% | 90% |
| Y40 | Q38E | Q39K | Q38K S114A | Q39E T192E | 64 | 100% | 100.0% | 58.21 | 61% | 90% |

TABLE 8-continued

Expression and biophysical characterization of variants of anti-CD40 × anti-PD-L1 Y-shaped antibodies.

| Clone | Fab 1 (CD40) | | Fab 2 (PD-L1) | | Yield [mg/L] | SEC [% Monomer] | HIC [% target] | Onset Tm [° C.] | RU CD40/RU Fc capture by SPR | RU PDL1/RU Fc capture by SPR |
|---|---|---|---|---|---|---|---|---|---|---|
| | LC1 | HC1 | LC2 | HC2 | | | | | | |
| Y41 | Q38E V133T S176V | Q39K L143Q S188V | Q38K E123K N137K | Q39E T192E K221E | 82 | 99% | 100.0% | 58.00 | 64% | 90% |
| Y42 | Q38E | Q39K | Q38K S114A V133T N137K S176V | Q39E L143Q S188V T192E K221E | 99 | 99% | 100.0% | 58.55 | 60% | 90% |

An anti-PD-1×anti-OX40 antibody with different various mutations than the previous anti-PD-1×anti-OX40 antibody was tested. Table 9 below provides a summary of expression and biophysical characterization of variants of a PD1×OX40 bispecific antibody having varied Fab interface mutations. As shown in Table 9, CH1/CL mutations in pairs L143/S176 or L124N133 in combination with VHNL interface mutations at positions VH38NL39 significantly increased the amount of correct paired species as observed by HIC profile and verified by MS analysis (FIG. 9A-FIG. 9C and FIG. 10A-FIG. 10L).

TABLE 9

Expression and biophysical characterization of variants of the anti-PD-1 × anti-OX40 Y-shaped antibodies.

| Clone | Fab 1 (OX40) | | Fab 2 (PD1) | | Yield [mg/L] | SEC [% Monomer] | HIC [% target] | Onset Tm [° C.] | RU Ox40/RU Fc capture by SPR | RU PD1/RU Fc capture by SPR |
|---|---|---|---|---|---|---|---|---|---|---|
| | LC1 | HC1 | LC2 | HC2 | | | | | | |
| Y13 | | | | | 54 | 96.5% | 36.8% | 60.0 | 5% | 20% |
| Y1 | Q38E S176E | Q39K L143R | Q38K S176R | Q39E L143E | 38.4 | 93.3% | 91.9% | 59.0 | 13% | 17% |
| Y2 | Q38E S176E | Q39K L143K | Q38K S176K | Q39E L143E | 35.3 | 93.8% | 92.7% | 60.1 | 12% | 18% |
| Y3 | Q38E S176E | Q39K L143H | Q38K S176H | Q39E L143E | 44.3 | 93.7% | 87.2% | 59.5 | 12% | 19% |
| Y4 | Q38E S176D | Q39K L143R | Q38K S176R | Q39E L143D | 26.8 | 94.2% | 88.6% | 58.8 | 13% | 18% |
| Y5 | Q38E S176D | Q39K L143K | Q38K S176K | Q39E L143D | 25.4 | 92.9% | 86.3% | 59.9 | 13% | 18% |
| Y6 | Q38E S176D | Q39K L143H | Q38K S176H | Q39E L143D | 33.3 | 92.1% | 83.1% | 58.9 | 12% | 18% |
| Y7 | Q38E V133E | Q39K L124R | Q38K V133R | Q39E L124E | 34.2 | 85.4% | 78.6% | 59.9 | 14% | 17% |
| Y8 | Q38E V133E | Q39K L124K | Q38K V133K | Q39E L124E | 15.1 | 98.9% | 95.6% | 58.4 | 11% | 20% |
| Y9 | Q38E V133E | Q39K L124H | Q38K V133H | Q39E L124E | 16.5 | 97.5% | 92.1% | 59.5 | 11% | 20% |
| Y10 | Q38E V133D | Q39K L124R | Q38K V133R | Q39E L124D | 16.4 | 89.1% | 91.7% | 59.9 | 13% | 18% |
| Y11 | Q38E V133D | Q39K L124K | Q38K V133K | Q39E L124D | 12.9 | 90.6% | 97.0% | 58.8 | 12% | 19% |
| Y12 | Q38E V133D | Q39K L124H | Q38K V133H | Q39E L124D | 11.2 | 87.6% | 67.2% | 58.9 | 11% | 19% |

Antigen-binding levels in the SPR data in Tables 7-9 are reported relative to the captured antibody level (RU antigen/RU Fc capture) for better comparison among constructs. The SPR data in Tables 7-9 show that all tested antibody constructs bound their respective antigen with comparable binding levels.

Example 5: General Expression and Purification Scheme for Example 6 and Example 7

Analytical Size-Exclusion Chromatography (SEC)

Analytical SEC was performed using a BioSECcurity instrument (PSS Polymer) with a AdvanceBio 300 column (4.6 mm×300 mm) and AdvanceBio 300 guard column (Agilent Technologies) at 2500. The analysis was run at a flow rate of 0.5 ml/min using 2× concentrated D-PBS buffer (Thermo Fisher Scientific) with detection at 280 nm. 10 µl of protein sample (at 1 mg/ml) were applied onto the column. Data evaluation was performed using WinGPC software v8.1 (PSS Polymer). For estimation of the molecular weight, the SEC column was calibrated with a protein calibration standard mix (Agilent Technologies).

Analytical Hydrophobic-Interaction Chromatography (HIC)

Analytical HIC was performed using a LC10 HPLC instrument (Shimadzu) or a Vanquish HPLC instrument (Thermo Fisher Scientific) equipped with a TSKgel Butyl-NPR column (2.5 µm, 4.6×35 mm) (Tosoh Bioscience) at 25° C. The analysis was run at a flow rate of 1 ml/min with detection at 280 nm. 5 µg of undiluted protein sample was applied onto the column. Gradient elution was from 15% B to 85% B in 7 min followed by 1 min to 100% B, then 1 min to 15% B and then 3 minutes equilibration at 15% B. Buffer A was composed of 1.5 M ammonium sulfate, 25 mM sodium phosphate pH 7.0. Buffer B was composed of 25 mM sodium phosphate pH 7.0. Data evaluation was performed either using LabSolutions software v5.85 (Shimadzu) or Chromeleon 7 software (Thermo Fisher Scientific).

Mass Spectrometry (MS)

Protein integrity and potential mispairing of heterodimeric constructs was analyzed by LC-mass spectrometry (LC-MS). Protein samples were deglycosylated with 12.5 µg of protein diluted to 0.17 mg/ml in LC-MS grade water (Thermo Scientific) treated with 0.5 µl PNGaseF (glycerol free, New England Biolabs) at 37° C. for 16 hours. The LC-MS analysis was performed using a Thermo Fisher Orbitrap Lumos LC/MS instrument. Reversed phase (RP) chromatography was done using a MabPac RP HPLC column, analytical 4 µm particle size, 2.1×100 mm (Thermo Scientific) at 300 µL/min. Eluents were LC water, 0.1% formic acid (A) and 90% acetonitrile, 10% LC water, 0.1% formic acid (B). 2 µg of protein were injected onto the column and eluted using a linear gradient from 0% to 95% B in 12 minutes. Data analysis was done using Expressionist software 13.0.3 (Genedata). Molecular masses were calculated based on the amino acid sequences of the proteins using GPMAW software version 10.32b1 (Lighthouse data).

Surface Plasmon Resonance (SPR)

Binding of antigens to the antibody constructs was measured using surface plasmon resonance (SPR) with a BIAcore T200 instrument (GE Healthcare) with HBS-EP+buffer (GE Healthcare). For assessment of relative binding levels (% Rmax) of the antibodies for their respective antigens, the antibodies were captured by anti-Fc affinity capture to the sensor chip. In this assay, recombinant human antigens were used (PD-L1-His (9049-B7-100, R&D Systems), CD40-His (10774-H08H, Sino Biological), TNFα (130-094-022, Miltenyi), GITR-His (produced internally), PD1-His (8986-PD-100, R&D Systems), CD3s5-FLAG-His (#CT038-H2508H, Sino Biological) and human CD123 (#301-R3/CF, R&D Systems)). The anti-human Fc capture antibody (human antibody capture kit, GE Life Sciences) was immobilized via primary amine groups (11000 RU) on a research grade CM5 chip (GE Life Sciences) using standard procedures. The antibodies were captured at a flow rate of 10 µl/min with an adjusted RU value that resulted in maximal analyte binding of 10 to 30 RU. The antigens were used as analytes and injected at either 400 nM and 100 nM concentration for CD3s5-FLAG-His or at 100 nM concentration for all other antigens used. The antigens were injected for 240 sec with a dissociation time of 300 sec at a flow rate of 30 µL/min. Chip surfaces were regenerated with 2 min injects of the regeneration buffer provided with the capture kit. Sensorgrams were double referenced with a blank chip surface and HBS-EP buffer blanks. Data analysis and binding level determination were performed using the Biacore 8K Evaluation software v1.11.7442 (GE Healthcare). The % Rmax values were calculated using the maximum binding level divided by the theoretical Rmax value. The Rmax values were calculated from the capture level Rcapture, the binding stochiometry N and the molecular weight of antibody Mw(Ab) and antigen Mw(Ag) with Rmax=Rcapture*N*(Mw(Ag)/Mw(Ab).

Nano Differential Scanning Fluorimetry (nanoDSF)

Onset temperatures (Tonset) and melting points (Tm) of protein denaturation were determined using nano differential scanning fluorimetry (nanoDSF). Samples were diluted in formulation buffer to a final concentration of 0.5 µg/µl and loaded into nanoDSF capillaries (Nanotemper Technologies) in duplicates. All measurements were done using a Prometheus NT.plex nanoDSF device (Nanotemper Technologies). Heating rate was 1° C. per minute from 20° C. to 95° C. Data were recorded using PR.ThermControl Software v2.3.1 (Nanotemper Technologies) and analyzed using PR.Stability Analysis Software v1.0.3 (Nanotemper Technologies.

Example 6: Additional Y-Shaped Antibody Mutations

Additional bispecific antibodies with Y-shaped architecture were generated and tested with different sets of mutations. Specifically, an anti-PD-1×anti-OX40 antibody was employed with the mutations recited below in Table 10. The data below shows that all Y-shaped antibodies with Fab mutations had reduced mispairing compared to a wildtype control. The antibody with the VH39NL38 opposite charge mutations set, the L143/S176 opposite charge mutation set, and the combined K221E:K228D/E123K: D122K opposite charge mutation set (Protein ID Y61) displayed excellent results, with no detected mispairing.

TABLE 10

Expression and biophysical characterization of variants of the anti-PD-1 × anti-OX40 Y-shaped antibodies.

| Prote in ID | Fab 1 (OX40) | | Fab 2 (PD1) | | Yield [mg/L] | SEC [% Monomer] | HIC [% target] | MS | | |
|---|---|---|---|---|---|---|---|---|---|---|
| | | | | | | | | LC1 + HC1 LC1 + HC2 | LC1 + HC1 LC2 + HC2 | LC2 + HC1 LC2 + HC2 |
| | LC1 | HC1 | LC2 | HC2 | | | | | | |
| Y13 | | | | | 74 | 97 | 41.3% | 40.2% | 51.1% | 8.7% |
| Y58 | Q38K | Q39E | Q38E | Q39K | 25 | 98 | 96.7% | n.d0 | 99.6% | 0.4% |

TABLE 10-continued

Expression and biophysical characterization of variants of the anti-PD-1 × anti-OX40 Y-shaped antibodies.

| Prote in ID | Fab 1 (OX40) LC1 | Fab 1 (OX40) HC1 | Fab 2 (PD1) LC2 | Fab 2 (PD1) HC2 | Yield [mg/L] | SEC [% Monomer] | HIC [% target] | MS LC1 + HC1 LC1 + HC2 | MS LC1 + HC1 LC2 + HC2 | MS LC2 + HC1 LC2 + HC2 |
|---|---|---|---|---|---|---|---|---|---|---|
| Y59 | S176E E123K Q38K S176E | L143R K221E Q39E L143R | S176R Q38E S176R | L143E Q39K L143E | 29 | 98 | 93.6% | 0 | 98.5% | 1.5% |
| Y60 | D122K Q38K S176E | K228D Q39E L143R | Q38E S176R | Q39K L143E | 76 | 98.7% | 93.3% | n.d | 95.6% | 4.4% |
| Y61 | Q38K S176E E123K D122K | Q39E L143R K221E K228D | Q38E S176R | Q39K L143E | 57 | 99.6% | 100% | n.d | 100% | n.d |

Example 7: Additional Heterodimerization Enabling Mutations in the Y-Shaped Antibody Format Additional Y-shaped antibodies with different sets of heterodimerizing mutations were tested. Table 11 below recites biophysical characterization data of each Y-shaped antibody tested. As recited in Table 11 and FIG. 11A-FIG. 11E, "CM1" refers to the VH39K/VL38E mutation pair, "CM2" refers to the VH39E/VL38K mutation pair, "CM3" refers to the CH1 L143E or L143D/CL S176R or S176K mutation pair, "CM4" refers to the CH1 L143R or L143K/CL S176E or S176D mutation pair, and "NN3" refers to the CH1 K221E and K228D/CL D122K and E123K mutation pair.

TABLE 11

Heterodimerization mutations for tandem Fab antibodies.

| Protein ID | Protein Name | Yield [mg/L] | SEC [% monomer] | HIC [% monomer] | MS correct paired LC1 + HC1 LC2 + HC2 | MS Mispaired LC1 + HC1 LC1 + HC2 | MS Mispaired LC2 + HC1 LC2 + HC2 |
|---|---|---|---|---|---|---|---|
| Y43 | (PD1 × GITR)-huIgG | 99 | 99.9 | 58.8 | 91 | | 9 |
| Y44 | (PD1-CM1 × GITR-CM2)-huIgG1-NN3 | 73 | 100.0 | 72.3 | 100 | | |
| Y45 | (PD1-CM1/CM3 × GITR-CM2/CM4)-huIgG1-NN3 | 48 | 99.4 | 70.9 | 100 | | |
| Y46 | (TNF × GITR)-huIgG1 | 156 | 98.6 | 63.3 | 75 | 25 | |
| Y47 | (TNF-CM1 × GITR-CM2)-huIgG1-NN3 | 123 | 93.6 | 61.6 | 97 | 3 | |
| Y48 | (TNF-CM1/CM3 × GITR-CM2/CM4)-huIgG1-NN3 | 114 | 98.9 | 70.0 | 100 | | |
| Y49 | (TNF × OX40)-huIgG1 | 149 | 96.5 | 60.0 | 100 | | |
| Y50 | (TNF-CM1 × OX40-CM2)-huIgG1-NN3 | 94 | 77.0 | 56.6 | 100 | | |
| Y51 | (TNF-CM1/CM3 × OX40-CM2/CM4)-huIgG1-NN3 | 52 | 75.8 | 63.0 | 100 | | |
| Y53 | (CD40-CM1 × PDL1-CM2)-huIgG1-NN3 | 90 | 76.3 | 61.4 | 37 | | 63 |
| Y54 | (CD40-CM1/CM3 × PDL1-CM2/CM4)-huIgG1-NN3 | 90 | 98.8 | 64.5 | 61 | | 39 |
| Y52 | (CD40 × PDL1)-huIgG1 | 96 | 94.5 | 55.2 | 86 | | 14 |
| Y55 | (CD3 × CD123)-huIgG1 | 23 | 99.8 | 46.9 | 61 | 15 | 24 |
| Y56 | (CD3-CM1 × CD123-CM2)-huIgG1-NN3 | 79 | 94.3 | 55.4 | 93 | | 7 |
| Y57 | (CD3-CM1/CM3 × CD123-CM2/CM4)-huIgG1-NN3 | 40 | 89.1 | 59.2 | 95 | | 5 |

| Protein ID | DSF Tonset [° C.] | DSF Tm1 [° C.] | SPR % Rmax huPD1 | SPR % Rmax huGITR | SPR % Rmax huTNFa | SPR % Rmax huOx40 | SPR % Rmax huCD40 | SPR % Rmax huPD-L1 | SPR % Rmax huCD3 | SPR % Rmax huCD123 | Cytotox EC50 [pM] |
|---|---|---|---|---|---|---|---|---|---|---|---|
| Y43 | 59.9 | 67.8 | 85 | 84 | | | | | | | |
| Y44 | 63.1 | 65.1 | 94 | 87 | | | | | | | |

TABLE 11-continued

Heterodimerization mutations for tandem Fab antibodies.

| | | | | | | | | | | | |
|---|---|---|---|---|---|---|---|---|---|---|---|
| Y45 | 61.2 | 63.7 | 95 | 88 | | | | | | | |
| Y46 | 58.4 | 64.4 | | 73 | 38 | | | | | | |
| Y47 | 57.6 | 64.7 | | 85 | 42 | | | | | | |
| Y48 | 57.6 | 64.0 | | 94 | 40 | | | | | | |
| Y49 | 55.5 | 64.6 | | | 44 | 87 | | | | | |
| Y50 | 53.3 | 65.2 | | | 54 | 79 | | | | | |
| Y51 | 54.5 | 63.8 | | | 51 | 72 | | | | | |
| Y53 | 58.1 | 63.9 | | | | | 35 | 84 | | | |
| Y54 | 58.2 | 63.9 | | | | | 57 | 85 | | | |
| Y52 | 57.4 | 63.8 | | | | | 28 | 80 | | | |
| Y55 | 58.0 | 63.9 | | | | | | | 25 | 67 | 2.5 |
| Y56 | 59.4 | 63.2 | | | | | | | 41 | 64 | 1.6 |
| Y57 | 57.8 | 62.7 | | | | | | | 35 | 83 | 0.8 |

Figure 11A:
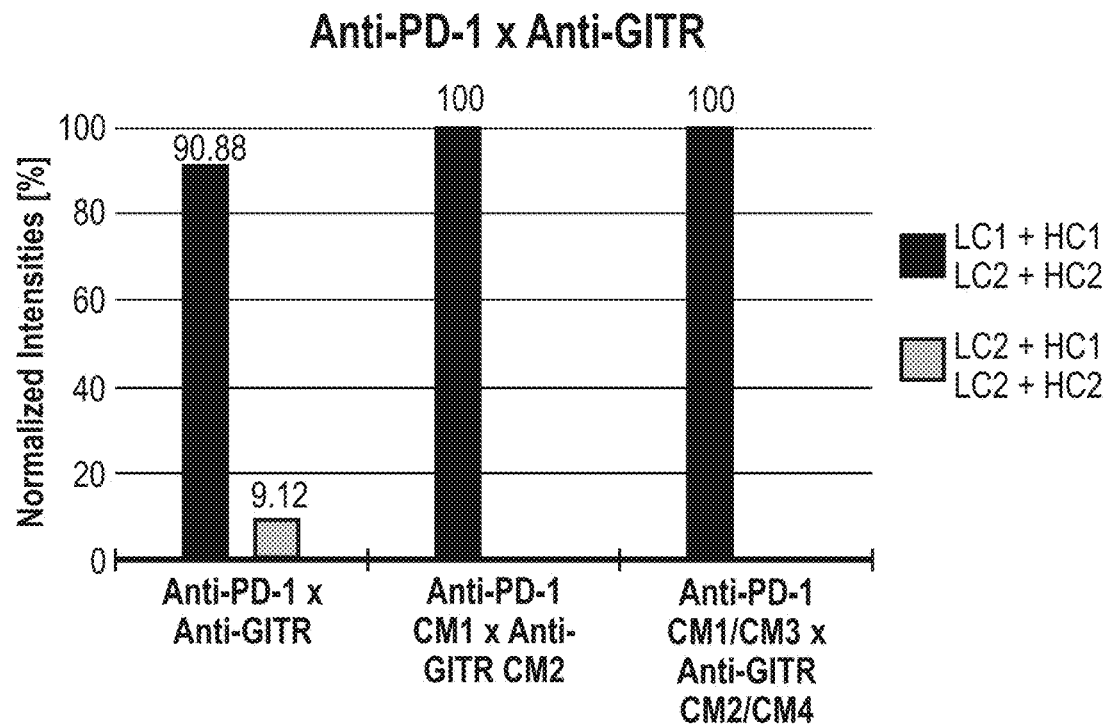
FIG. 11A-FIG. 11E depicts chain mispairing data for various Y-shaped antibodies.
Figure 11B:
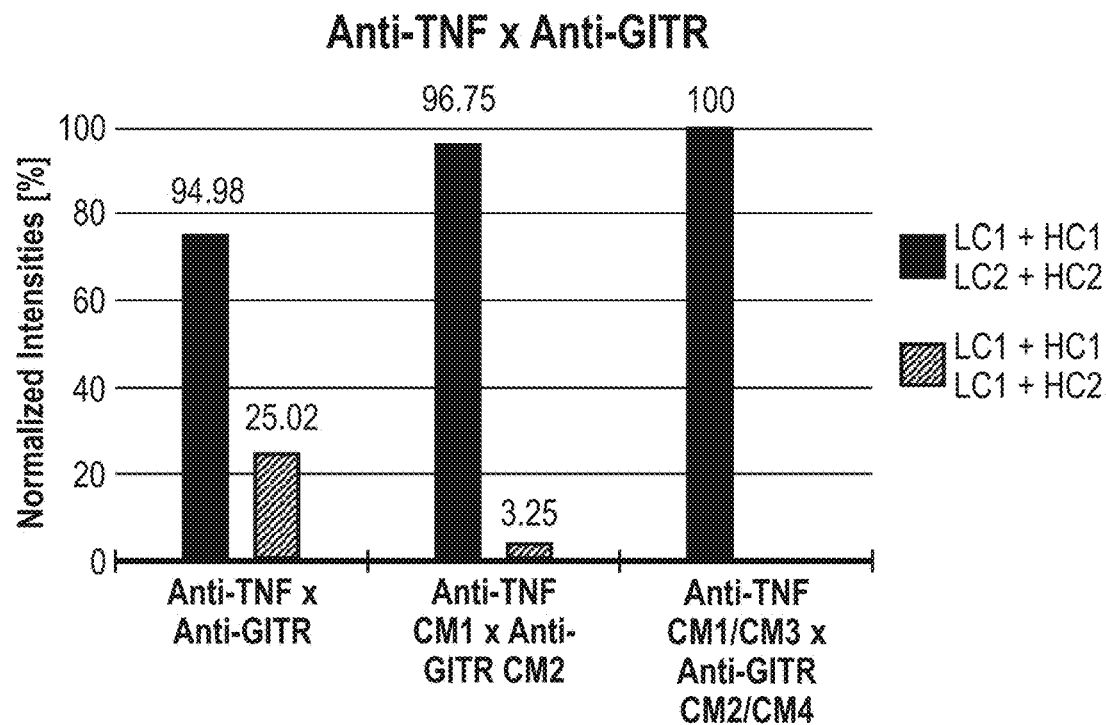
Figure 11C:
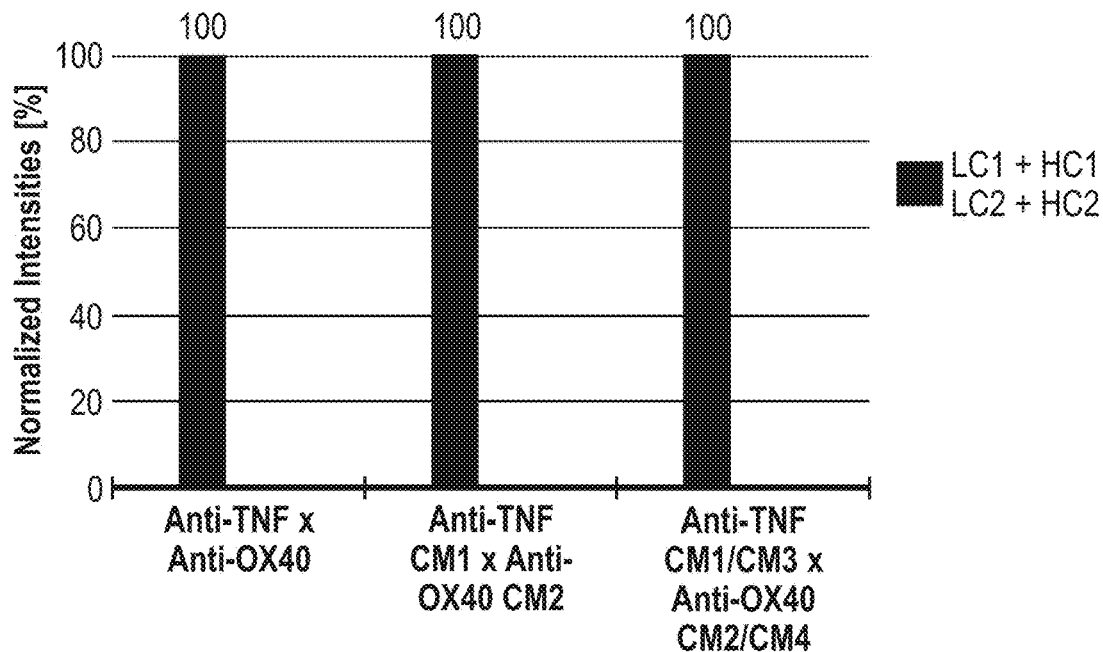
Figure 11D:
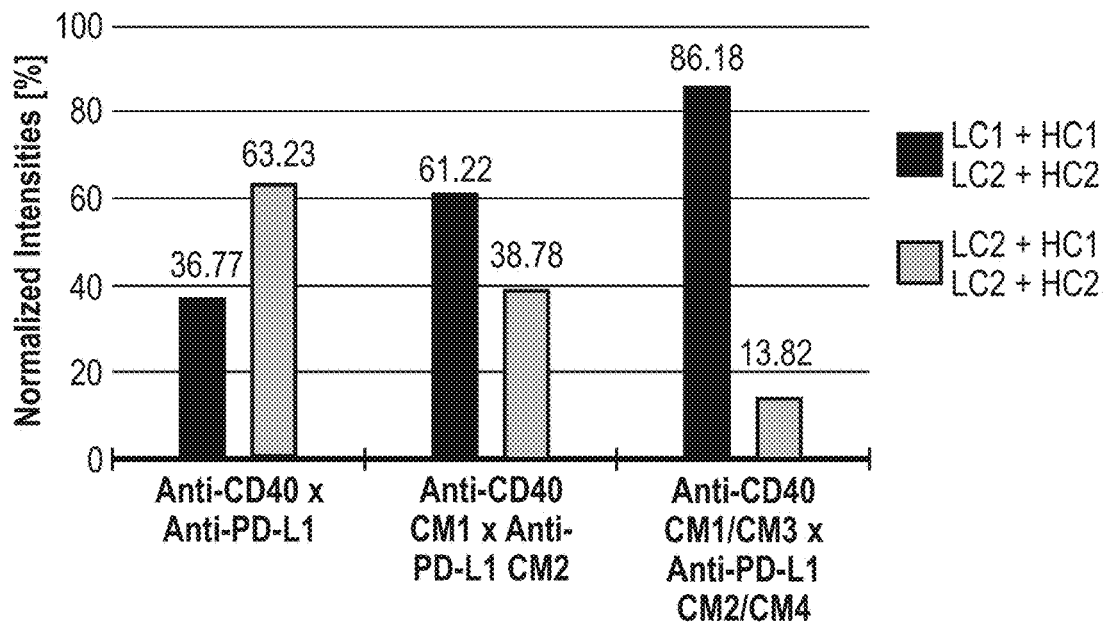
Figure 11E:
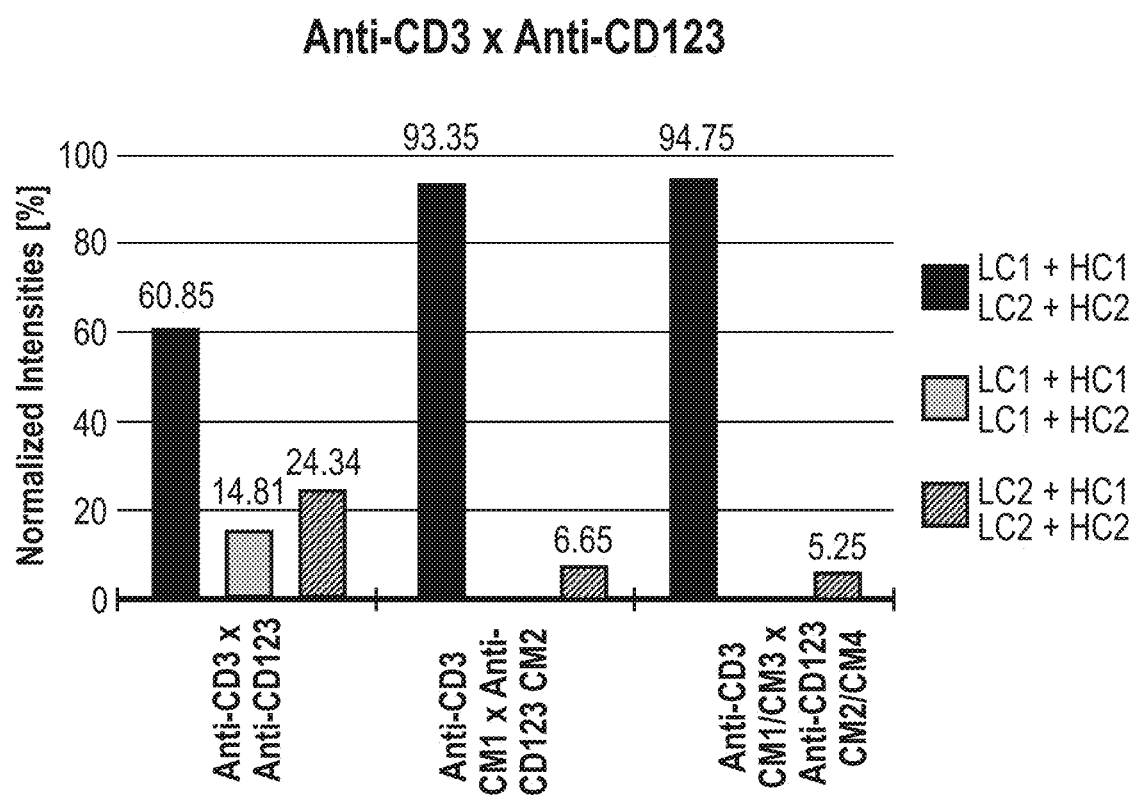

As shown in Table 11 and FIGS. 11A-11E, the various heterodimerization mutations employed each reduce mispairing compared to a wild type antibody. In the case of the anti-TNFxanti-OX40 antibody (Y49), which is known to not have mispairing in a wild type configuration, the inclusion of heterodimerization mutations did not negatively impact mispairing (FIG. 11C).

In addition to the above biophysical characterization, the T cell engager antibody, CD3×CD123, was in a cell-based cytotoxicity assay. Bispecific antibody molecules were analyzed in cytotoxicity assays using primary human T cells. Human peripheral mononuclear cells from blood of healthy donors were isolated in Leucosep-Tubes (Greiner Bio-One, #227290) using 15 ml Histopaque (Sigma-Aldrich, #10771) and centrifugation for 10 min at 1000×g. Isolated PBMCs were washed twice in autoMACS Rinsing buffer (Miltenyi Biotec, #130-091-222) supplemented with 5% MACS BSA stock solution (Miltenyi Biotec, #130-091-370). Primary human T cells were isolated from human PBMCs with the MACSpro Separator (Miltenyi Biotec) and the Pan T cell Isolation Kit (Miltenyi Biotec, #130-096-535) using manufactures' protocols. Isolated human T cells were resuspended at $5\times10^6$ cells/mL in RPMI GlutaMAX I media (Gibco, #72400) supplemented with 10% FCS HI (Gibco, #10082-147). Prior to cytotoxicity assay, THP-1 target cells (ADCC TIB-202) were stained with 1 μM CFSE (Invitrogen, #C1157) for 15 min at 37° C. Cells were washed twice in RPMI+GlutaMAX I media and centrifuged at 400×g for 5 min. THP-1 target cells were resuspended at $5\times10^5$ cells/mL in RPMI media supplemented with 10% FCS HI. CFSE-labeled THP-1 cells and human pan T cells were mixed in a 10:1 effector to target ratio and seeded in a total volume of 100 μl/well in a 96-well assay plate (Greiner BioOne, #650185). Bispecific antibody molecules were added in 11 dilution series starting from 10 nM-0 nM (1:6 dilution) in a volume of 5 μL/well to the cells and incubated for 20 hours at 37° C. and 5% $CO_2$. After incubation, cells were stained with 5 μg/ml 7-AAD (Invitrogen, #A1310) for 30 min at 4° C. To determine cytotoxicity dead target cells were measured by gating on CFSE/7-AAD double positive THP-1 cells on a LSRII flow cytometer (BD) and EC50 values were determined with Xlfit software.

Figure 12:
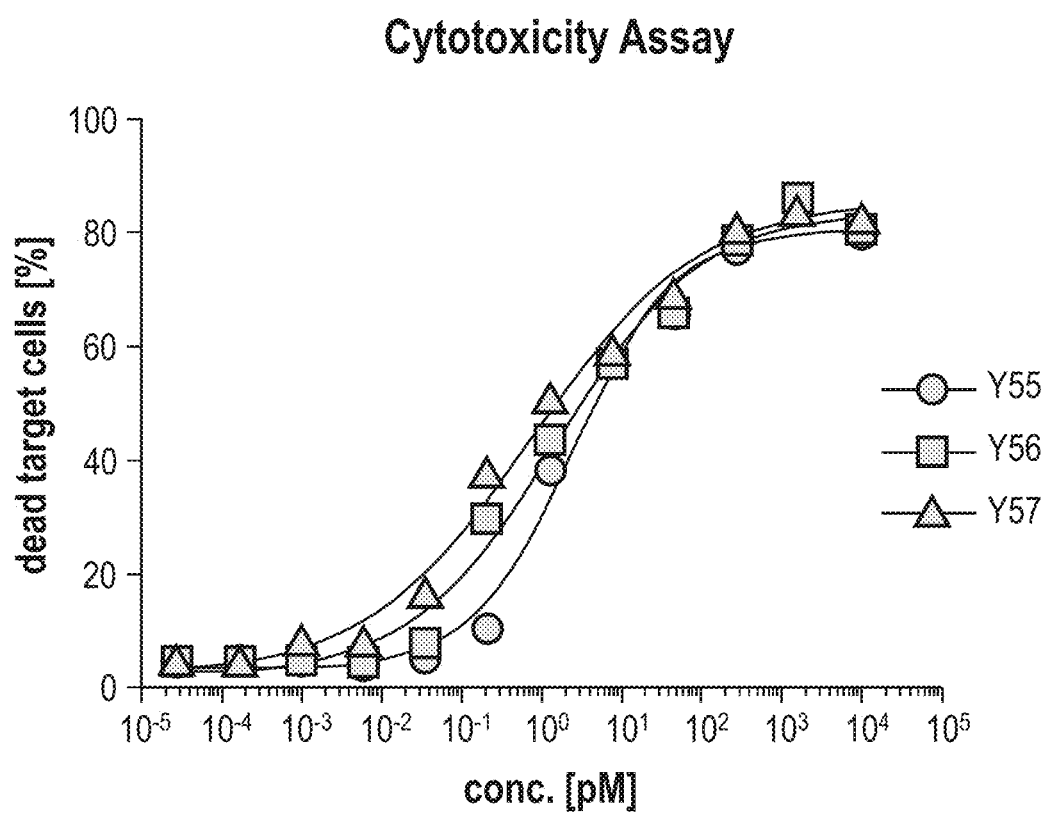
FIG. 12 depicts a cytotoxic assay of human panT cells against THP-1 target cells co-incubated with bispecific CD3×CD123-hIgG1-LALA molecules. T effector cells and CFSE-labeled THP-1 target cells were seeded in an effector to target ratio of 10:1 and co-incubated with serial dilutions of respective bispecific molecules (10 nM-0 nM) for 20h at 37° C. Dead cells were stained with 7-AAD and measured by flow cytometry. Cytotoxic activity was calculated based on percentage of dead THP-1 target cells (7-AAD/CFSE double positive). Data show dead target cells [%] against concentration of bispecific molecules [pM] as mean of two representative healthy donors.

As shown in FIG. 12, all three CD3×CD123 bispecific antibodies demonstrated comparable and robust activity. The presence of heterodimerization mutations in Y56 and Y57 did not negatively impact activity, while reducing chain mispairing.

SEQUENCE LISTING (334 sequences)

SEQ ID NO: 1 - protein, 25 aa, Artificial Sequence
  source: /note="Description of Artificial Sequence: Synthetic peptide"
  SITE (1)..(25): /note="This sequence may encompass 1-5 'Gly Gly Gly Gly Ser' repeating units"
GGGGSGGGGSGGGGSGGGGSGGGGS

SEQ ID NO: 2 - protein, 34 aa, Artificial Sequence
  source: /note="Description of Artificial Sequence: Synthetic polypeptide"
EPKSCDKTHTSPPSPAPELLGGPSTPPTPSPSGG

SEQ ID NO: 3 - protein, 4 aa, Artificial Sequence
  source: /note="Description of Artificial Sequence: Synthetic peptide"
GGGG

SEQ ID NO: 4 - protein, 5 aa, Artificial Sequence
  source: /note="Description of Artificial Sequence: Synthetic peptide"
GGGGG

SEQ ID NO: 5 - protein, 6 aa, Artificial Sequence
  source: /note="Description of Artificial Sequence: Synthetic peptide"
GGGGGG

SEQ ID NO: 6 - protein, 7 aa, Artificial Sequence
  source: /note="Description of Artificial Sequence: Synthetic peptide"
GGGGGGG

SEQ ID NO: 7 - protein, 8 aa, Artificial Sequence
  source: /note="Description of Artificial Sequence: Synthetic peptide"
GGGGGGGG

SEQ ID NO: 8 - protein, 4 aa, Artificial Sequence
  source: /note="Description of Artificial Sequence: Synthetic peptide"
GGGS

SEQ ID NO: 9 - protein, 5 aa, Artificial Sequence
  source: /note="Description of Artificial Sequence: Synthetic peptide"
GGGGS

SEQ ID NO: 10 - protein, 10 aa, Artificial Sequence
  source: /note="Description of Artificial Sequence: Synthetic peptide"
GGGGSGGGGS

SEQ ID NO: 11 - protein, 15 aa, Artificial Sequence
  source: /note="Description of Artificial Sequence: Synthetic peptide"
GGGGSGGGGSGGGGS

SEQ ID NO: 12 - protein, 10 aa, Artificial Sequence
  source: /note="Description of Artificial Sequence: Synthetic peptide"
GGSGSSGSGG

SEQ ID NO: 13 - protein, 5 aa, Artificial Sequence
  source: /note="Description of Artificial Sequence: Synthetic peptide"
TKGPS

SEQ ID NO: 14 - protein, 5 aa, Artificial Sequence
  source: /note="Description of Artificial Sequence: Synthetic peptide"
TVAAP

SEQ ID NO: 15 - protein, 5 aa, Artificial Sequence
  source: /note="Description of Artificial Sequence: Synthetic peptide"
QPKAA

SEQ ID NO: 16 - protein, 5 aa, Artificial Sequence
  source: /note="Description of Artificial Sequence: Synthetic peptide"
QRIEG

SEQ ID NO: 17 - protein, 7 aa, Artificial Sequence
  source: /note="Description of Artificial Sequence: Synthetic peptide"
ASTKGPS

SEQ ID NO: 18 - protein, 7 aa, Artificial Sequence
  source: /note="Description of Artificial Sequence: Synthetic peptide"
RTVAAPS

SEQ ID NO: 19 - protein, 7 aa, Artificial Sequence
  source: /note="Description of Artificial Sequence: Synthetic peptide"
GQPKAAP

SEQ ID NO: 20 - protein, 7 aa, Artificial Sequence
  source: /note="Description of Artificial Sequence: Synthetic peptide"
HIDSPNK

SEQ ID NO: 21 - protein, 5 aa, Artificial Sequence
  source: /note="Description of Artificial Sequence: Synthetic peptide"
DKTHT

SEQ ID NO: 22 - protein, 6 aa, Artificial Sequence
  source: /note="Description of Artificial Sequence: Synthetic peptide"
TKGPSR

SEQ ID NO: 23 - protein, 25 aa, Artificial Sequence
  source: /note="Description of Artificial Sequence: Synthetic peptide"
  SITE (1)..(25): /note="This sequence may encompass 0-5 'Gly Gly Gly Gly Ser' repeating units"
GGGGSGGGGSGGGGSGGGGSGGGGS

SEQ ID NO: 24 - protein, 19 aa, Homo sapiens
VPSTPPTPSPSTPPTPSPS

SEQ ID NO: 25 - protein, 6 aa, Homo sapiens
VPPPPP

SEQ ID NO: 26 - protein, 58 aa, Homo sapiens
ESPKAQASSVPTAQPQAEGSLAKATTAPATTRNTGRGGEEKKKEKEKEEQEERETKTP

SEQ ID NO: 27 - protein, 15 aa, Homo sapiens
EPKSCDKTHTCPPCP

SEQ ID NO: 28 - protein, 12 aa, Homo sapiens
ERKCCVECPPCP

SEQ ID NO: 29 - protein, 17 aa, Homo sapiens
ELKTPLGDTTHTCPRCP

SEQ ID NO: 30 - protein, 60 aa, Homo sapiens
  SITE (1)..(60): /note="This sequence may encompass 0-4 'Glu Pro Lys Ser Cys Asp Thr Pro Pro Pro Cys Pro Arg Cys Pro' repeating units"
EPKSCDTPPPCPRCPEPKSCDTPPPCPRCPEPKSCDTPPPCPRCPEPKSCDTPPPCPRCP

SEQ ID NO: 31 - protein, 77 aa, Homo sapiens
  SITE (18)..(77): /note="This region may encompass 1-4 'Glu Pro Lys Ser Cys Asp Thr Pro Pro Pro Cys Pro Arg Cys Pro' repeating units or may be absent in its entirety"
ELKTPLGDTTHTCPRCPEPKSCDTPPPCPRCPEPKSCDTPPPCPRCPEPKSCDTPPPCPRCPEPKSCDTPPPCPRCP

SEQ ID NO: 32 - protein, 12 aa, Homo sapiens
ESKYGPPCPSCP

SEQ ID NO: 33 - protein, 34 aa, Artificial Sequence
  source: /note="Description of Artificial Sequence: Synthetic polypeptide"
EPKSCDKTHTCPPCPAPELLGGPSTPPTPSPSGG

SEQ ID NO: 34 - protein, 9 aa, Homo sapiens
APELLGGPS

SEQ ID NO: 35 - protein, 8 aa, Homo sapiens
TPPTPSPS

SEQ ID NO: 36 - protein, 19 aa, Artificial Sequence
  source: /note="Description of Artificial Sequence: Synthetic peptide"
APELLGGPSTPPTPSPSGG

SEQ ID NO: 37 - protein, 1130 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPAPAPELLGGPSGPPGPGPGGGQVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 38 - protein, 1125 aa, Artificial Sequence
  source: /note="Description of Artificial Sequence: Synthetic polypeptide"
EIVMTQSPATLSVSPGERATLSCKASQNVGTNVAWYQQKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVTLRESGPALVKPTQTLTLTCTFSGFSLSTSGMGVGWIRQPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 39 - protein, 1125 aa, Artificial Sequence
  source: /note="Description of Artificial Sequence: Synthetic polypeptide"
EIVMTQSPATLSVSPGERATLSCKASQNVGTNVAWYQKKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVTLRESGPALVKPTQTLTLTCTFSGFSLSTSGMGVGWIREPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 40 - protein, 1125 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVTLRESGPALVKPTQTLTLTCTFSGFSLSTSGMGVGWIRQPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVMTQSPATLSVSPGERATLSCKASQNVGTNVAWYQQKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 1125 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVTLRESGPALVKPTQTLTLTCTFSGFSLSTSGMGVGWIREPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVMTQSPATLSVSPGERATLSCKASQNVGTNVAWYQKKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 1125 aa, Artificial Sequence
  source: /note="Description of Artificial Sequence: Synthetic polypeptide"
EIVMTQSPATLSVSPGERATLSCKASQNVGTNVAWYQQKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVTLRESGPALVKPTQTLTLTCTFSGFSLSTSGMGVGWIRQPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 43 - protein, 1125 aa, Artificial Sequence
  source: /note="Description of Artificial Sequence: Synthetic polypeptide"
EIVMTQSPATLSVSPGERATLSCKASQNVGTNVAWYQKKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVTLRESGPALVKPTQTLTLTCTFSGFSLSTSGMGVGWIREPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 44 - protein, 1125 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVTLRESGPALVKPTQTLTLTCTFSGFSLSTSGMGVGWIRQPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVMTQSPATLSVSPGERATLSCKASQNVGTNVAWYQQKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 1125 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVTLRESGPALVKPTQTLTLTCTFSGFSLSTSGMGVGWIREPPGKALEWLAHIWWDDDKYYNPSLKSRLTISKDTSKNQVVLTMTNMDPVDTATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVMTQSPATLSVSPGERATLSCKASQNVGTNVAWYQKKPGQAPRLLIYSASYRYSGIPARFSGSGSGTEFTLTISSLQSEDFAVYYCQQYNTDPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 46 - protein, 1119 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPAPAPELLGGPSGPPGPGPGGGEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 47 - protein, 1130 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVQLVESGGGVVQPGRSLRLSCAASGFTFSSYGMHWVREAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAIQLTQSPSSLSASVGDRVTITCRASQGISSALAWYQKKPGKAPKLLIYDASSLESGVPSRFSGSGSGTDFTLTISSLQPEDFATYYCQQFNSYPYTFGQGTKLEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 1133 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 1133 aa, Artificial Sequence
  source: /note="Description of Artificial Sequence: Synthetic polypeptide"
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 50 - protein, 1133 aa, Artificial Sequence
  source: /note="Description of Artificial Sequence: Synthetic polypeptide"
DIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVESGGGLVQPGGSLRLSCAASGFTFSDSWIHWVRKAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVQLVQSGAEVKKPGASVKVSCKASGYTFTGYYMHWVREAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSVSASVGDRVTITCRASQGIYSWLAWYQKKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 1119 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 1133 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 53 - protein, 1133 aa, Artificial Sequence
  source: /note="Description of Artificial Sequence: Synthetic polypeptide"
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 54 - protein, 1133 aa, Artificial Sequence
  source: /note="Description of Artificial Sequence: Synthetic polypeptide"
DIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVESGGGLVQPGGSLRLSCAASGFTFSDSWIHWVRKAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVQLVQSGAEVKKPGASVKVSCKASGYTFTGYYMHWVREAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSVSASVGDRVTITCRASQGIYSWLAWYQKKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 1119 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 56 - protein, 1119 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 57 - protein, 1119 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSTPPTPSPSGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 1133 aa, Artificial Sequence
  source: /note="Description of Artificial Sequence: Synthetic polypeptide"
DIQMTQSPSSVSASVGDRVTITCRASQGIYSWLAWYQKKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVQSGAEVKKPGASVKVSCKASGYTFTGYYMHWVREAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSTPPTPSPSGGEVQLVESGGGLVQPGGSLRLSCAASGFTFSDSWIHWVRKAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 59 - protein, 1119 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 60 - protein, 1119 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 61 - protein, 1119 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGECEVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTAPPAPAPELLGGPSTPPTPSPSGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 1133 aa, Artificial Sequence
  source: /note="Description of Artificial Sequence: Synthetic polypeptide"
DIQMTQSPSSVSASVGDRVTITCRASQGIYSWLAWYQKKPGKAPNLLIYTASTLQSGVPSRFSGSGSGTDFTLTISSLQPEDFATYYCQQANIFPLTFGGGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGECQVQLVQSGAEVKKPGASVKVSCKASGYTFTGYYMHWVREAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTAPPAPAPELLGGPSTPPTPSPSGGEVQLVESGGGLVQPGGSLRLSCAASGFTFSDSWIHWVRKAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCRASQDVSTAVAWYQEKPGKAPKLLIYSASFLYSGVPSRFSGSGSGTDFTLTISSLQPEDFATYYCQQYLYHPATFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 63 - protein, 341 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSGGGGSDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 341 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSGGGGSDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKGGGGSGGGGSRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 65 - protein, 341 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGQGTKVEIKGGGGSGGGGSDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKGGGGSGGGGSRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 66 - protein, 341 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGCGTKVEIKGGGGSGGGGSDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGCGTKVEIKGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 341 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGCGTKVEIKGGGGSGGGGSDIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGCGTKVEIKGGGGSGGGGSRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 68 - protein, 341 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGCGTKVEIKGGGGSGGGGSDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGCGTKVEIKGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 341 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGCGTKVEIKGGGGSGGGGSDIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGCGTKVEIKGGGGSGGGGSRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 70 - protein, 559 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 71 - protein, 559 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 72 - protein, 559 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRKAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 73 - protein, 559 aa, Artificial Sequence
  source: /note="Description of Artificial Sequence: Synthetic polypeptide"
EVQLVQSGAEVKKPGASVKVSCKASGYTFTDSYMSWVRQAPGQCLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRQAPGKCLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 74 - protein, 559 aa, Artificial Sequence
  source: /note="Description of Artificial Sequence: Synthetic polypeptide"
EVQLVQSGAEVKKPGASVKVSCKASGYTFTDSYMSWVRQAPGQCLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRQAPGKCLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 75 - protein, 559 aa, Artificial Sequence
  source: /note="Description of Artificial Sequence: Synthetic polypeptide"
EVQLVQSGAEVKKPGASVKVSCKASGYTFTDSYMSWVRKAPGQCLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRKAPGKCLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 76 - protein, 559 aa, Artificial Sequence
  source: /note="Description of Artificial Sequence: Synthetic polypeptide"
EVQLVQSGAEVKKPGASVKVSCKASGYTFTDSYMSWVRKAPGQCLEWIGDMYPDNGDSSYNQKFRERVTITRDTSTSTAYLELSSLRSEDTAVYYCVLAPRWYFSVWGQGTLVTVSSQVQLVESGGGVVQPGRSLRLDCKASGITFSNSGMHWVRKAPGKCLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 453 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 78 - protein, 453 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 79 - protein, 453 aa, Artificial Sequence
  source: /note="Description of Artificial Sequence: Synthetic polypeptide"
QVQLVESGGGVVQPGRSLRLSCAASGFTFSSYGMHWVREAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 80 - protein, 453 aa, Artificial Sequence; identical to SEQ ID NO: 77
  source: /note="Description of Artificial Sequence: Synthetic polypeptide"

SEQ ID NO: 81 - protein, 453 aa, Artificial Sequence; identical to SEQ ID NO: 78
  source: /note="Description of Artificial Sequence: Synthetic polypeptide"

SEQ ID NO: 82 - protein, 453 aa, Artificial Sequence
  source: /note="Description of Artificial Sequence: Synthetic polypeptide"
QVQLVESGGGVVQPGRSLRLSCAASGFTFSSYGMHWVREAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 83 - protein, 453 aa, Artificial Sequence; identical to SEQ ID NO: 79
  source: /note="Description of Artificial Sequence: Synthetic polypeptide"

SEQ ID NO: 84 - protein, 214 aa, Artificial Sequence
  source: /note="Description of Artificial Sequence: Synthetic polypeptide"
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 214 aa, Artificial Sequence
  source: /note="Description of Artificial Sequence: Synthetic polypeptide"
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 214 aa, Artificial Sequence
  source: /note="Description of Artificial Sequence: Synthetic polypeptide"
AIQLTQSPSSLSASVGDRVTITCRASQGISSALAWYQKKPGKAPKLLIYDASSLESGVPSRFSGSGSGTDFTLTISSLQPEDFATYYCQQFNSYPYTFGQGTKLEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 214 aa, Artificial Sequence; identical to SEQ ID NO: 84
  source: /note="Description of Artificial Sequence: Synthetic polypeptide"

SEQ ID NO: 88 - protein, 214 aa, Artificial Sequence; identical to SEQ ID NO: 85
  source: /note="Description of Artificial Sequence: Synthetic polypeptide"

SEQ ID NO: 89 - protein, 214 aa, Artificial Sequence
  source: /note="Description of Artificial Sequence: Synthetic polypeptide"
AIQLTQSPSSLSASVGDRVTITCRASQGISSALAWYQKKPGKAPKLLIYDASSLESGVPSRFSGSGSGTDFTLTISSLQPEDFATYYCQQFNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 214 aa, Artificial Sequence; identical to SEQ ID NO: 86
  source: /note="Description of Artificial Sequence: Synthetic polypeptide"

SEQ ID NO: 91 - protein, 214 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 92 - protein, 214 aa, Artificial Sequence; identical to SEQ ID NO: 91
  source: /note="Description of Artificial Sequence: Synthetic polypeptide"

SEQ ID NO: 93 - protein, 214 aa, Artificial Sequence; identical to SEQ ID NO: 91
  source: /note="Description of Artificial Sequence: Synthetic polypeptide"

SEQ ID NO: 94 - protein, 214 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLDSTLTLSKADYEKHKVYACEVTHQGLSSPVTKSFNRGEC

SEQ ID NO: 95 - protein, 214 aa, Artificial Sequence; identical to SEQ ID NO: 94
  source: /note="Description of Artificial Sequence: Synthetic polypeptide"

SEQ ID NO: 96 - protein, 214 aa, Artificial Sequence; identical to SEQ ID NO: 94
  source: /note="Description of Artificial Sequence: Synthetic polypeptide"

SEQ ID NO: 97 - protein, 214 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 214 aa, Artificial Sequence; identical to SEQ ID NO: 97
  source: /note="Description of Artificial Sequence: Synthetic polypeptide"

SEQ ID NO: 99 - protein, 214 aa, Artificial Sequence; identical to SEQ ID NO: 97
  source: /note="Description of Artificial Sequence: Synthetic polypeptide"

SEQ ID NO: 100 - protein, 214 aa, Artificial Sequence
  source: /note="Description of Artificial Sequence: Synthetic polypeptide"
DIQMTQSPSSLSASVGDRVTITCRASQDISNYLNWYQEKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVDCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 214 aa, Artificial Sequence; identical to SEQ ID NO: 100
  source: /note="Description of Artificial Sequence: Synthetic polypeptide"

SEQ ID NO: 102 - protein, 214 aa, Artificial Sequence; identical to SEQ ID NO: 100
  source: /note="Description of Artificial Sequence: Synthetic polypeptide"

SEQ ID NO: 103 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 105 - protein, 214 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 214 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGQGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 107 - protein, 214 aa, Artificial Sequence; identical to SEQ ID NO: 104
  source: /note="Description of Artificial Sequence: Synthetic polypeptide"

SEQ ID NO: 108 - protein, 214 aa, Artificial Sequence; identical to SEQ ID NO: 103
  source: /note="Description of Artificial Sequence: Synthetic polypeptide"

SEQ ID NO: 109 - protein, 214 aa, Artificial Sequence
  source: /note="Description of Artificial Sequence: Synthetic polypeptide"
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 110 - protein, 214 aa, Artificial Sequence; identical to SEQ ID NO: 109
  source: /note="Description of Artificial Sequence: Synthetic polypeptide"

SEQ ID NO: 111 - protein, 214 aa, Artificial Sequence
  source: /note="Description of Artificial Sequence: Synthetic polypeptide"
DIQMTQSPSSVSASVGDRVTITCRASQGIYSWLAWYQEKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 214 aa, Artificial Sequence
  source: /note="Description of Artificial Sequence: Synthetic polypeptide"
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 214 aa, Artificial Sequence; identical to SEQ ID NO: 103
  source: /note="Description of Artificial Sequence: Synthetic polypeptide"

SEQ ID NO: 114 - protein, 214 aa, Artificial Sequence; identical to SEQ ID NO: 104
  source: /note="Description of Artificial Sequence: Synthetic polypeptide"

SEQ ID NO: 115 - protein, 214 aa, Artificial Sequence; identical to SEQ ID NO: 103
  source: /note="Description of Artificial Sequence: Synthetic polypeptide"

SEQ ID NO: 116 - protein, 214 aa, Artificial Sequence; identical to SEQ ID NO: 104
  source: /note="Description of Artificial Sequence: Synthetic polypeptide"

SEQ ID NO: 117 - protein, 214 aa, Artificial Sequence; identical to SEQ ID NO: 103
  source: /note="Description of Artificial Sequence: Synthetic polypeptide"

SEQ ID NO: 118 - protein, 214 aa, Artificial Sequence; identical to SEQ ID NO: 112
  source: /note="Description of Artificial Sequence: Synthetic polypeptide"

SEQ ID NO: 119 - protein, 214 aa, Artificial Sequence; identical to SEQ ID NO: 109
  source: /note="Description of Artificial Sequence: Synthetic polypeptide"

SEQ ID NO: 120 - protein, 214 aa, Artificial Sequence; identical to SEQ ID NO: 112
  source: /note="Description of Artificial Sequence: Synthetic polypeptide"

SEQ ID NO: 121 - protein, 214 aa, Artificial Sequence; identical to SEQ ID NO: 109
  source: /note="Description of Artificial Sequence: Synthetic polypeptide"

SEQ ID NO: 122 - protein, 214 aa, Artificial Sequence; identical to SEQ ID NO: 112
  source: /note="Description of Artificial Sequence: Synthetic polypeptide"

SEQ ID NO: 123 - protein, 214 aa, Artificial Sequence; identical to SEQ ID NO: 105
  source: /note="Description of Artificial Sequence: Synthetic polypeptide"

SEQ ID NO: 124 - protein, 214 aa, Artificial Sequence; identical to SEQ ID NO: 106
  source: /note="Description of Artificial Sequence: Synthetic polypeptide"

SEQ ID NO: 125 - protein, 214 aa, Artificial Sequence; identical to SEQ ID NO: 105
  source: /note="Description of Artificial Sequence: Synthetic polypeptide"

SEQ ID NO: 126 - protein, 214 aa, Artificial Sequence; identical to SEQ ID NO: 106
  source: /note="Description of Artificial Sequence: Synthetic polypeptide"

SEQ ID NO: 127 - protein, 214 aa, Artificial Sequence; identical to SEQ ID NO: 105
  source: /note="Description of Artificial Sequence: Synthetic polypeptide"

SEQ ID NO: 128 - protein, 214 aa, Artificial Sequence; identical to SEQ ID NO: 111
  source: /note="Description of Artificial Sequence: Synthetic polypeptide"

SEQ ID NO: 129 - protein, 214 aa, Artificial Sequence
  source: /note="Description of Artificial Sequence: Synthetic polypeptide"
DIQMTQSPSSVSASVGDRVTITCRASQGIYSWLAWYQEKPGKAPNLLIYTASTLQSGVPSRFSGSGSGTDFTLTISSLQPEDFATYYCQQANIFPLTFGGGTKVEIKRTVAAPSVFIFPPSDEQLKSGTASVTCLLNNFYPREAKVQWKVDNALQSGNSQESVTEQDSKDSTYSLVSTLTLSKADYEKHKVYACEVTHQGLSSPVTKSFNRGEC

SEQ ID NO: 130 - protein, 214 aa, Artificial Sequence; identical to SEQ ID NO: 111
  source: /note="Description of Artificial Sequence: Synthetic polypeptide"

SEQ ID NO: 131 - protein, 214 aa, Artificial Sequence; identical to SEQ ID NO: 129
  source: /note="Description of Artificial Sequence: Synthetic polypeptide"

SEQ ID NO: 132 - protein, 214 aa, Artificial Sequence; identical to SEQ ID NO: 111
  source: /note="Description of Artificial Sequence: Synthetic polypeptide"

SEQ ID NO: 133 - protein, 214 aa, Artificial Sequence; identical to SEQ ID NO: 103
  source: /note="Description of Artificial Sequence: Synthetic polypeptide"

SEQ ID NO: 134 - protein, 214 aa, Artificial Sequence; identical to SEQ ID NO: 105
  source: /note="Description of Artificial Sequence: Synthetic polypeptide"

SEQ ID NO: 135 - protein, 214 aa, Artificial Sequence
  source: /note="Description of Artificial Sequence: Synthetic polypeptide"
EIVLTQSPATLSLSPGERATLSCRASQSVSSYLAWYQEKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLRSTLTLSKADYEKHKVYACEVTHQGLSSPVTKSFNRGEC

SEQ ID NO: 136 - protein, 214 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 214 aa, Artificial Sequence
  source: /note="Description of Artificial Sequence: Synthetic polypeptide"
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 214 aa, Artificial Sequence
  source: /note="Description of Artificial Sequence: Synthetic polypeptide"
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLRSTLTLSKADYEKHKVYACEVTHQGLSSPVTKSFNRGEC

SEQ ID NO: 139 - protein, 214 aa, Artificial Sequence; identical to SEQ ID NO: 136
  source: /note="Description of Artificial Sequence: Synthetic polypeptide"

SEQ ID NO: 140 - protein, 214 aa, Artificial Sequence; identical to SEQ ID NO: 137
  source: /note="Description of Artificial Sequence: Synthetic polypeptide"

SEQ ID NO: 141 - protein, 214 aa, Artificial Sequence; identical to SEQ ID NO: 138
  source: /note="Description of Artificial Sequence: Synthetic polypeptide"

SEQ ID NO: 142 - protein, 214 aa, Artificial Sequence; identical to SEQ ID NO: 112
  source: /note="Description of Artificial Sequence: Synthetic polypeptide"

SEQ ID NO: 143 - protein, 214 aa, Artificial Sequence; identical to SEQ ID NO: 111
  source: /note="Description of Artificial Sequence: Synthetic polypeptide"

SEQ ID NO: 144 - protein, 214 aa, Artificial Sequence
  source: /note="Description of Artificial Sequence: Synthetic polypeptide"
DIQMTQSPSSVSASVGDRVTITCRASQGIYSWLAWYQEKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLRSTLTLSKADYEKHKVYACEVTHQGLSSPVTKSFNRGEC

SEQ ID NO: 145 - protein, 219 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 219 aa, Artificial Sequence
  source: /note="Description of Artificial Sequence: Synthetic polypeptide"
DIVMTQTPLSLSVTPGQPASISCKSSQSLVHENLQTYLSWYLEKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 219 aa, Artificial Sequence
  source: /note="Description of Artificial Sequence: Synthetic polypeptide"
DIVMTQTPLSLSVTPGQPASISCKSSQSLVHENLQTYLSWYLEKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLRSTLTLSKADYEKHKVYACEVTHQGLSSPVTKSFNRGEC

SEQ ID NO: 148 - protein, 214 aa, Artificial Sequence; identical to SEQ ID NO: 135
  source: /note="Description of Artificial Sequence: Synthetic polypeptide"

SEQ ID NO: 149 - protein, 214 aa, Artificial Sequence; identical to SEQ ID NO: 135
  source: /note="Description of Artificial Sequence: Synthetic polypeptide"

SEQ ID NO: 150 - protein, 214 aa, Artificial Sequence; identical to SEQ ID NO: 135
  source: /note="Description of Artificial Sequence: Synthetic polypeptide"

SEQ ID NO: 151 - protein, 214 aa, Artificial Sequence; identical to SEQ ID NO: 135
  source: /note="Description of Artificial Sequence: Synthetic polypeptide"

SEQ ID NO: 152 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 153 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCKVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 154 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCHVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 155 - protein, 446 aa, Artificial Sequence; identical to SEQ ID NO: 152
  source: /note="Description of Artificial Sequence: Synthetic polypeptide"

SEQ ID NO: 156 - protein, 446 aa, Artificial Sequence; identical to SEQ ID NO: 153
  source: /note="Description of Artificial Sequence: Synthetic polypeptide"

SEQ ID NO: 157 - protein, 446 aa, Artificial Sequence; identical to SEQ ID NO: 154
  source: /note="Description of Artificial Sequence: Synthetic polypeptide"

SEQ ID NO: 158 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPRAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 159 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPKAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 160 - protein, 446 aa, Artificial Sequence
  source: /note="Description of Artificial Sequence: Synthetic polypeptide"
EVQLVQSGAEVKKPGASVKVSCKASGYTFTDSYMSWVRKAPGQGLEWIGDMYPDNGDSSYNQKFRERVTITRDTSTSTAYLELSSLRSEDTAVYYCVLAPRWYFSVWGQGTLVTVSSASTKGPSVFPHAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 161 - protein, 446 aa, Artificial Sequence; identical to SEQ ID NO: 158
  source: /note="Description of Artificial Sequence: Synthetic polypeptide"

SEQ ID NO: 162 - protein, 446 aa, Artificial Sequence; identical to SEQ ID NO: 159
  source: /note="Description of Artificial Sequence: Synthetic polypeptide"

SEQ ID NO: 163 - protein, 446 aa, Artificial Sequence; identical to SEQ ID NO: 160
  source: /note="Description of Artificial Sequence: Synthetic polypeptide"

SEQ ID NO: 164 - protein, 442 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 165 - protein, 442 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 166 - protein, 442 aa, Artificial Sequence
  source: /note="Description of Artificial Sequence: Synthetic polypeptide"
QVQLVESGGGVVQPGRSLRLDCKASGITFSNSGMHWVRKAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 167 - protein, 442 aa, Artificial Sequence
  source: /note="Description of Artificial Sequence: Synthetic polypeptide"
QVQLVESGGGVVQPGRSLRLDCKASGITFSNSGMHWVRKAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 168 - protein, 442 aa, Artificial Sequence; identical to SEQ ID NO: 165
  source: /note="Description of Artificial Sequence: Synthetic polypeptide"

SEQ ID NO: 169 - protein, 442 aa, Artificial Sequence; identical to SEQ ID NO: 164
  source: /note="Description of Artificial Sequence: Synthetic polypeptide"

SEQ ID NO: 170 - protein, 455 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 171 - protein, 455 aa, Artificial Sequence; identical to SEQ ID NO: 170
  source: /note="Description of Artificial Sequence: Synthetic polypeptide"

SEQ ID NO: 172 - protein, 455 aa, Artificial Sequence
  source: /note="Description of Artificial Sequence: Synthetic polypeptide"
QVQLVQSGAEVKKPGASVKVSCKASGYTFTGYYMHWVRKAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 173 - protein, 455 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 174 - protein, 442 aa, Artificial Sequence; identical to SEQ ID NO: 164
  source: /note="Description of Artificial Sequence: Synthetic polypeptide"

SEQ ID NO: 175 - protein, 442 aa, Artificial Sequence; identical to SEQ ID NO: 165
  source: /note="Description of Artificial Sequence: Synthetic polypeptide"

SEQ ID NO: 176 - protein, 442 aa, Artificial Sequence; identical to SEQ ID NO: 164
  source: /note="Description of Artificial Sequence: Synthetic polypeptide"

SEQ ID NO: 177 - protein, 442 aa, Artificial Sequence; identical to SEQ ID NO: 165
  source: /note="Description of Artificial Sequence: Synthetic polypeptide"

SEQ ID NO: 178 - protein, 442 aa, Artificial Sequence; identical to SEQ ID NO: 164
  source: /note="Description of Artificial Sequence: Synthetic polypeptide"

SEQ ID NO: 179 - protein, 455 aa, Artificial Sequence; identical to SEQ ID NO: 173
  source: /note="Description of Artificial Sequence: Synthetic polypeptide"

SEQ ID NO: 180 - protein, 455 aa, Artificial Sequence; identical to SEQ ID NO: 170
  source: /note="Description of Artificial Sequence: Synthetic polypeptide"

SEQ ID NO: 181 - protein, 455 aa, Artificial Sequence; identical to SEQ ID NO: 173
  source: /note="Description of Artificial Sequence: Synthetic polypeptide"

SEQ ID NO: 182 - protein, 455 aa, Artificial Sequence; identical to SEQ ID NO: 170
  source: /note="Description of Artificial Sequence: Synthetic polypeptide"

SEQ ID NO: 183 - protein, 455 aa, Artificial Sequence; identical to SEQ ID NO: 173
  source: /note="Description of Artificial Sequence: Synthetic polypeptide"

SEQ ID NO: 184 - protein, 442 aa, Artificial Sequence; identical to SEQ ID NO: 166
  source: /note="Description of Artificial Sequence: Synthetic polypeptide"

SEQ ID NO: 185 - protein, 442 aa, Artificial Sequence; identical to SEQ ID NO: 167
  source: /note="Description of Artificial Sequence: Synthetic polypeptide"

SEQ ID NO: 186 - protein, 442 aa, Artificial Sequence; identical to SEQ ID NO: 166
  source: /note="Description of Artificial Sequence: Synthetic polypeptide"

SEQ ID NO: 187 - protein, 442 aa, Artificial Sequence; identical to SEQ ID NO: 167
  source: /note="Description of Artificial Sequence: Synthetic polypeptide"

SEQ ID NO: 188 - protein, 442 aa, Artificial Sequence; identical to SEQ ID NO: 166
  source: /note="Description of Artificial Sequence: Synthetic polypeptide"

SEQ ID NO: 189 - protein, 455 aa, Artificial Sequence; identical to SEQ ID NO: 172
  source: /note="Description of Artificial Sequence: Synthetic polypeptide"

SEQ ID NO: 190 - protein, 455 aa, Artificial Sequence
  source: /note="Description of Artificial Sequence: Synthetic polypeptide"
QVQLVQSGAEVKKPGASVKVSCKASGYTFTGYYMHWVRKAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCQVKDYFPEPVTVSWNSGALTSGVHTFPAVLQSSGLYSLVSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 191 - protein, 455 aa, Artificial Sequence; identical to SEQ ID NO: 172
  source: /note="Description of Artificial Sequence: Synthetic polypeptide"

SEQ ID NO: 192 - protein, 455 aa, Artificial Sequence; identical to SEQ ID NO: 190
  source: /note="Description of Artificial Sequence: Synthetic polypeptide"

SEQ ID NO: 193 - protein, 455 aa, Artificial Sequence; identical to SEQ ID NO: 172
  source: /note="Description of Artificial Sequence: Synthetic polypeptide"

SEQ ID NO: 194 - protein, 442 aa, Artificial Sequence; identical to SEQ ID NO: 164
  source: /note="Description of Artificial Sequence: Synthetic polypeptide"

SEQ ID NO: 195 - protein, 442 aa, Artificial Sequence; identical to SEQ ID NO: 166
  source: /note="Description of Artificial Sequence: Synthetic polypeptide"

SEQ ID NO: 196 - protein, 442 aa, Artificial Sequence
  source: /note="Description of Artificial Sequence: Synthetic polypeptide"
QVQLVESGGGVVQPGRSLRLDCKASGITFSNSGMHWVRKAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 197 - protein, 450 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 198 - protein, 450 aa, Artificial Sequence
  source: /note="Description of Artificial Sequence: Synthetic polypeptide"
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - protein, 450 aa, Artificial Sequence
  source: /note="Description of Artificial Sequence: Synthetic polypeptide"
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 450 aa, Artificial Sequence; identical to SEQ ID NO: 197
  source: /note="Description of Artificial Sequence: Synthetic polypeptide"

SEQ ID NO: 201 - protein, 450 aa, Artificial Sequence; identical to SEQ ID NO: 198
  source: /note="Description of Artificial Sequence: Synthetic polypeptide"

SEQ ID NO: 202 - protein, 450 aa, Artificial Sequence; identical to SEQ ID NO: 199
  source: /note="Description of Artificial Sequence: Synthetic polypeptide"

SEQ ID NO: 203 - protein, 455 aa, Artificial Sequence; identical to SEQ ID NO: 173
  source: /note="Description of Artificial Sequence: Synthetic polypeptide"

SEQ ID NO: 204 - protein, 455 aa, Artificial Sequence; identical to SEQ ID NO: 172
  source: /note="Description of Artificial Sequence: Synthetic polypeptide"

SEQ ID NO: 205 - protein, 455 aa, Artificial Sequence
  source: /note="Description of Artificial Sequence: Synthetic polypeptide"
QVQLVQSGAEVKKPGASVKVSCKASGYTFTGYYMHWVRKAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 450 aa, Artificial Sequence
  source: /note="Description of Artificial Sequence: Synthetic polypeptide"
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 207 - protein, 450 aa, Artificial Sequence
  source: /note="Description of Artificial Sequence: Synthetic polypeptide"
QVQLVESGGGVVQPGRSLRLSCAASGFTFTKAWMHWVRKAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 450 aa, Artificial Sequence
  source: /note="Description of Artificial Sequence: Synthetic polypeptide"
QVQLVESGGGVVQPGRSLRLSCAASGFTFTKAWMHWVRKAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 209 - protein, 442 aa, Artificial Sequence; identical to SEQ ID NO: 196
  source: /note="Description of Artificial Sequence: Synthetic polypeptide"

SEQ ID NO: 210 - protein, 442 aa, Artificial Sequence; identical to SEQ ID NO: 196
  source: /note="Description of Artificial Sequence: Synthetic polypeptide"

SEQ ID NO: 211 - protein, 442 aa, Artificial Sequence; identical to SEQ ID NO: 196
  source: /note="Description of Artificial Sequence: Synthetic polypeptide"

SEQ ID NO: 212 - protein, 442 aa, Artificial Sequence; identical to SEQ ID NO: 196
  source: /note="Description of Artificial Sequence: Synthetic polypeptide"

SEQ ID NO: 213 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLRSTLTLSKADYEKHKVYACEVTHQGLSSPVTKSFNRGEC

SEQ ID NO: 214 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 215 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLHSTLTLSKADYEKHKVYACEVTHQGLSSPVTKSFNRGEC

SEQ ID NO: 216 - protein, 214 aa, Artificial Sequence; identical to SEQ ID NO: 213
  source: /note="Description of Artificial Sequence: Synthetic polypeptide"

SEQ ID NO: 217 - protein, 214 aa, Artificial Sequence; identical to SEQ ID NO: 214
  source: /note="Description of Artificial Sequence: Synthetic polypeptide"

SEQ ID NO: 218 - protein, 214 aa, Artificial Sequence; identical to SEQ ID NO: 215
  source: /note="Description of Artificial Sequence: Synthetic polypeptide"

SEQ ID NO: 219 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVRCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 214 aa, Artificial Sequence
  source: /note="Description of Artificial Sequence: Synthetic polypeptide"
EIVLTQSPATLSLSPGERATLSCRASQSVSSYLAWYQKKPGQAPRLLIYDASNRATGIPARFSGSGSGTDFTLTISSLEPEDFAVYYCQQSSNWPRTFGQGTKVEIKRTVAAPSVFIFPPSDEQLKSGTASVHCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 214 aa, Artificial Sequence; identical to SEQ ID NO: 219
  source: /note="Description of Artificial Sequence: Synthetic polypeptide"

SEQ ID NO: 223 - protein, 214 aa, Artificial Sequence; identical to SEQ ID NO: 220
  source: /note="Description of Artificial Sequence: Synthetic polypeptide"

SEQ ID NO: 224 - protein, 214 aa, Artificial Sequence; identical to SEQ ID NO: 221
  source: /note="Description of Artificial Sequence: Synthetic polypeptide"

SEQ ID NO: 225 - protein, 446 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 226 - protein, 446 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 227 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 228 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 229 - protein, 446 aa, Artificial Sequence; identical to SEQ ID NO: 225
  source: /note="Description of Artificial Sequence: Synthetic polypeptide"

SEQ ID NO: 230 - protein, 446 aa, Artificial Sequence; identical to SEQ ID NO: 226
  source: /note="Description of Artificial Sequence: Synthetic polypeptide"

SEQ ID NO: 231 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 232 - protein, 447 aa, Artificial Sequence; identical to SEQ ID NO: 231
  source: /note="Description of Artificial Sequence: Synthetic polypeptide"

SEQ ID NO: 233 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 234 - protein, 447 aa, Artificial Sequence; identical to SEQ ID NO: 231
  source: /note="Description of Artificial Sequence: Synthetic polypeptide"

SEQ ID NO: 235 - protein, 446 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 236 - protein, 446 aa, Artificial Sequence; identical to SEQ ID NO: 235
  source: /note="Description of Artificial Sequence: Synthetic polypeptide"

SEQ ID NO: 237 - protein, 446 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 238 - protein, 446 aa, Artificial Sequence; identical to SEQ ID NO: 237
  source: /note="Description of Artificial Sequence: Synthetic polypeptide"

SEQ ID NO: 239 - protein, 446 aa, Artificial Sequence
  source: /note="Description of Artificial Sequence: Synthetic polypeptide"
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 240 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 241 - protein, 447 aa, Artificial Sequence; identical to SEQ ID NO: 240
  source: /note="Description of Artificial Sequence: Synthetic polypeptide"

SEQ ID NO: 242 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 243 - protein, 447 aa, Artificial Sequence; identical to SEQ ID NO: 242
  source: /note="Description of Artificial Sequence: Synthetic polypeptide"

SEQ ID NO: 244 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 245 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 246 - protein, 446 aa, Artificial Sequence; identical to SEQ ID NO: 245
  source: /note="Description of Artificial Sequence: Synthetic polypeptide"

SEQ ID NO: 247 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 248 - protein, 446 aa, Artificial Sequence; identical to SEQ ID NO: 247
  source: /note="Description of Artificial Sequence: Synthetic polypeptide"

SEQ ID NO: 249 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCQVKDYFPEPVTVSWNSGALTSGVHTFPAVLQSSGLYSLVSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 250 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 251 - protein, 447 aa, Artificial Sequence; identical to SEQ ID NO: 250
  source: /note="Description of Artificial Sequence: Synthetic polypeptide"

SEQ ID NO: 252 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVEVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 253 - protein, 447 aa, Artificial Sequence; identical to SEQ ID NO: 252
  source: /note="Description of Artificial Sequence: Synthetic polypeptide"

SEQ ID NO: 254 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCQVKDYFPEPVTVSWNSGALTSGVHTFPAVLQSSGLYSLVSVVEVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 255 - protein, 453 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 256 - protein, 453 aa, Artificial Sequence
  source: /note="Description of Artificial Sequence: Synthetic polypeptide"
QVQLVESGGGVVQPGRSLRLSCAASGFTFSSYGMHWVREAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 257 - protein, 453 aa, Artificial Sequence
  source: /note="Description of Artificial Sequence: Synthetic polypeptide"
QVQLVESGGGVVQPGRSLRLSCAASGFTFSSYGMHWVREAPGKGLEWVAVIWYEGSNKYYADSVKGRFTISRDNSKNTLYLQMNSLRAEDTAVYYCARGGSMVRGDYYYGMDVWGQGTTVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 258 - protein, 453 aa, Artificial Sequence; identical to SEQ ID NO: 255
  source: /note="Description of Artificial Sequence: Synthetic polypeptide"

SEQ ID NO: 259 - protein, 453 aa, Artificial Sequence; identical to SEQ ID NO: 256
  source: /note="Description of Artificial Sequence: Synthetic polypeptide"

SEQ ID NO: 260 - protein, 453 aa, Artificial Sequence; identical to SEQ ID NO: 257
  source: /note="Description of Artificial Sequence: Synthetic polypeptide"

SEQ ID NO: 261 - protein, 446 aa, Artificial Sequence; identical to SEQ ID NO: 225
  source: /note="Description of Artificial Sequence: Synthetic polypeptide"

SEQ ID NO: 262 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 263 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 264 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 265 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 266 - protein, 447 aa, Artificial Sequence
  source: /note="Description of Artificial Sequence: Synthetic polypeptide"
EVQLVESGGGLVQPGGSLRLSCAASGFTFSDSWIHWVREAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 267 - protein, 449 aa, Artificial Sequence
  source: /note="Description of Artificial Sequence: Synthetic polypeptide"
EVQLVQSGAEVKKPGESLKISCKGSGYSFTDYYMKWARQMPGKGLEWMGDIIPSSGATFYNQKFKGQVTISADKSISTTYLQWSSLKASDTAMYYCARSHLLRASWFAYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 268 - protein, 449 aa, Artificial Sequence
  source: /note="Description of Artificial Sequence: Synthetic polypeptide"
EVQLVQSGAEVKKPGESLKISCKGSGYSFTDYYMKWAREMPGKGLEWMGDIIPSSGATFYNQKFKGQVTISADKSISTTYLQWSSLKASDTAMYYCARSHLLRASWFAYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 269 - protein, 449 aa, Artificial Sequence
  source: /note="Description of Artificial Sequence: Synthetic polypeptide"
EVQLVQSGAEVKKPGESLKISCKGSGYSFTDYYMKWAREMPGKGLEWMGDIIPSSGATFYNQKFKGQVTISADKSISTTYLQWSSLKASDTAMYYCARSHLLRASWFAYWGQGTMVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDEKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 270 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDEKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 271 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDKKVEPDSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 272 - protein, 446 aa, Artificial Sequence
  source: /note="Description of Artificial Sequence: Synthetic polypeptide"
EVQLVQSGAEVKKPGASVKVSCKASGYTFTDSYMSWVREAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCRVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 273 - protein, 446 aa, Artificial Sequence; identical to SEQ ID NO: 263
  source: /note="Description of Artificial Sequence: Synthetic polypeptide"

SEQ ID NO: 274 - protein, 451 aa, Artificial Sequence
  source: /note="Description of Artificial Sequence: Synthetic polypeptide"
QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCEVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH

SEQ ID NO: 275 - protein, 451 aa, Artificial Sequence; identical to SEQ ID NO: 274
  source: /note="Description of Artificial Sequence: Synthetic polypeptide"

SEQ ID NO: 276 - protein, 451 aa, Artificial Sequence; identical to SEQ ID NO: 274
  source: /note="Description of Artificial Sequence: Synthetic polypeptide"

SEQ ID NO: 277 - protein, 451 aa, Artificial Sequence
  source: /note="Description of Artificial Sequence: Synthetic polypeptide"
QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCDVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH

SEQ ID NO: 278 - protein, 451 aa, Artificial Sequence; identical to SEQ ID NO: 277
  source: /note="Description of Artificial Sequence: Synthetic polypeptide"

SEQ ID NO: 279 - protein, 451 aa, Artificial Sequence; identical to SEQ ID NO: 277
  source: /note="Description of Artificial Sequence: Synthetic polypeptide"

SEQ ID NO: 280 - protein, 451 aa, Artificial Sequence
  source: /note="Description of Artificial Sequence: Synthetic polypeptide"
QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPEAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH

SEQ ID NO: 281 - protein, 451 aa, Artificial Sequence; identical to SEQ ID NO: 280
  source: /note="Description of Artificial Sequence: Synthetic polypeptide"

SEQ ID NO: 282 - protein, 451 aa, Artificial Sequence; identical to SEQ ID NO: 280
  source: /note="Description of Artificial Sequence: Synthetic polypeptide"

SEQ ID NO: 283 - protein, 451 aa, Artificial Sequence
  source: /note="Description of Artificial Sequence: Synthetic polypeptide"
QVQLVESGGGVVQPGRSLRLDCKASGITFSNSGMHWVREAPGKGLEWVAVIWYDGSKRYYADSVKGRFTISRDNSKNTLFLQMNSLRAEDTAVYYCATNDDYWGQGTLVTVSSASTKGPSVFPDAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGAAHHHHHH

SEQ ID NO: 284 - protein, 451 aa, Artificial Sequence; identical to SEQ ID NO: 283
  source: /note="Description of Artificial Sequence: Synthetic polypeptide"

SEQ ID NO: 285 - protein, 451 aa, Artificial Sequence; identical to SEQ ID NO: 283
  source: /note="Description of Artificial Sequence: Synthetic polypeptide"

SEQ ID NO: 286 - protein, 214 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 214 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 214 aa, Artificial Sequence; identical to SEQ ID NO: 286
  source: /note="Description of Artificial Sequence: Synthetic polypeptide"

SEQ ID NO: 291 - protein, 214 aa, Artificial Sequence; identical to SEQ ID NO: 287
  source: /note="Description of Artificial Sequence: Synthetic polypeptide"

SEQ ID NO: 292 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPAVFIFPPSDEQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 293 - protein, 214 aa, Artificial Sequence; identical to SEQ ID NO: 292
  source: /note="Description of Artificial Sequence: Synthetic polypeptide"

SEQ ID NO: 294 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - protein, 214 aa, Artificial Sequence; identical to SEQ ID NO: 292
  source: /note="Description of Artificial Sequence: Synthetic polypeptide"

SEQ ID NO: 296 - protein, 214 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - protein, 214 aa, Artificial Sequence; identical to SEQ ID NO: 296
  source: /note="Description of Artificial Sequence: Synthetic polypeptide"

SEQ ID NO: 298 - protein, 214 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPAVFIFPPSDKQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 214 aa, Artificial Sequence; identical to SEQ ID NO: 298
  source: /note="Description of Artificial Sequence: Synthetic polypeptide"

SEQ ID NO: 300 - protein, 214 aa, Artificial Sequence
  source: /note="Description of Artificial Sequence: Synthetic polypeptide"
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPAVFIFPPSDEQLKSGTASVTCLLKNFYPREAKVQWKVDNALQSGNSQESVTEQDSKDSTYSLVSTLTLSKADYEKHKVYACEVTHQGLSSPVTKSFNRGEC

SEQ ID NO: 301 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 214 aa, Artificial Sequence; identical to SEQ ID NO: 301
  source: /note="Description of Artificial Sequence: Synthetic polypeptide"

SEQ ID NO: 303 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPAVFIFPPSDKQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 304 - protein, 214 aa, Artificial Sequence; identical to SEQ ID NO: 303
  source: /note="Description of Artificial Sequence: Synthetic polypeptide"

SEQ ID NO: 305 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPAVFIFPPSDEQLKSGTASVTCLLKNFYPREAKVQWKVDNALQSGNSQESVTEQDSKDSTYSLVSTLTLSKADYEKHKVYACEVTHQGLSSPVTKSFNRGEC

SEQ ID NO: 306 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSDKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 214 aa, Artificial Sequence; identical to SEQ ID NO: 306
  source: /note="Description of Artificial Sequence: Synthetic polypeptide"

SEQ ID NO: 308 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPAVFIFPPSDKQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 214 aa, Artificial Sequence; identical to SEQ ID NO: 308
  source: /note="Description of Artificial Sequence: Synthetic polypeptide"

SEQ ID NO: 310 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPAVFIFPPSDEQLKSGTASVTCLLKNFYPREAKVQWKVDNALQSGNSQESVTEQDSKDSTYSLVSTLTLSKADYEKHKVYACEVTHQGLSSPVTKSFNRGEC

SEQ ID NO: 311 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPSVFIFPPSDKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 214 aa, Artificial Sequence; identical to SEQ ID NO: 311
  source: /note="Description of Artificial Sequence: Synthetic polypeptide"

SEQ ID NO: 313 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPAVFIFPPSDKQLKSGTASVVCLLKNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 214 aa, Artificial Sequence; identical to SEQ ID NO: 313
  source: /note="Description of Artificial Sequence: Synthetic polypeptide"

SEQ ID NO: 315 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPAVFIFPPSDEQLKSGTASVTCLLKNFYPREAKVQWKVDNALQSGNSQESVTEQDSKDSTYSLVSTLTLSKADYEKHKVYACEVTHQGLSSPVTKSFNRGEC

SEQ ID NO: 316 - protein, 214 aa, Artificial Sequence; identical to SEQ ID NO: 84
  source: /note="Description of Artificial Sequence: Synthetic polypeptide"

SEQ ID NO: 317 - protein, 214 aa, Artificial Sequence
  source: /note="Description of Artificial Sequence: Synthetic polypeptide"
AIQLTQSPSSLSASVGDRVTITCRASQGISSALAWYQKKPGKAPKLLIYDASSLESGVPSRFSGSGSGTDFTLTISSLQPEDFATYYCQQFNSYPYTFGQGTKLEIKRTVAAPSVFIFPPSKKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 318 - protein, 214 aa, Artificial Sequence
  source: /note="Description of Artificial Sequence: Synthetic polypeptide"
AIQLTQSPSSLSASVGDRVTITCRASQGISSALAWYQKKPGKAPKLLIYDASSLESGVPSRFSGSGSGTDFTLTISSLQPEDFATYYCQQFNSYPYTFGQGTKLEIKRTVAAPSVFIFPPSKKQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 319 - protein, 214 aa, Artificial Sequence; identical to SEQ ID NO: 84
  source: /note="Description of Artificial Sequence: Synthetic polypeptide"

SEQ ID NO: 320 - protein, 214 aa, Artificial Sequence; identical to SEQ ID NO: 317
  source: /note="Description of Artificial Sequence: Synthetic polypeptide"

SEQ ID NO: 321 - protein, 214 aa, Artificial Sequence; identical to SEQ ID NO: 318
  source: /note="Description of Artificial Sequence: Synthetic polypeptide"

SEQ ID NO: 322 - protein, 214 aa, Artificial Sequence; identical to SEQ ID NO: 286
  source: /note="Description of Artificial Sequence: Synthetic polypeptide"

SEQ ID NO: 323 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSKKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSKKQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 325 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPSVFIFPPSKKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 214 aa, Artificial Sequence
  source: /note="Description of Artificial Sequence: Synthetic polypeptide"
DIQMTQSPSSLSASVGDRVTITCRASQDVSTAVAWYQKKPGKAPKLLIYSASFLYSGVPSRFSGSGSGTDFTLTISSLQPEDFATYYCQQYLYHPATFGQGTKVEIKRTVAAPSVFIFPPSKKQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 328 - protein, 220 aa, Artificial Sequence
  source: /note="Description of Artificial Sequence: Synthetic polypeptide"
DIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 220 aa, Artificial Sequence
  source: /note="Description of Artificial Sequence: Synthetic polypeptide"
DIVMTQSPDSLAVSLGERATINCESSQSLLNSGNQKNYLTWYQKKPGQPPKPLIYWASTRESGVPDRFSGSGSGTDFTLTISSLQAEDVAVYYCQNDYSYPYTFGQGTKLEIKRTVAAPSVFIFPPSKKQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 220 aa, Artificial Sequence
  source: /note="Description of Artificial Sequence: Synthetic polypeptide"
DIVMTQSPDSLAVSLGERATINCESSQSLLNSGNQKNYLTWYQKKPGQPPKPLIYWASTRESGVPDRFSGSGSGTDFTLTISSLQAEDVAVYYCQNDYSYPYTFGQGTKLEIKRTVAAPSVFIFPPSKKQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 331 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSDKQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 332 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSKEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 333 - protein, 214 aa, Artificial Sequence
  source: /note="Description of Artificial Sequence: Synthetic polypeptide"
DIQMTQSPSSLSASVGDRVTITCRASQDISNYLNWYQKKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 334 - protein, 214 aa, Artificial Sequence; identical to SEQ ID NO: 324
  source: /note="Description of Artificial Sequence: Synthetic polypeptide"

What is claimed is:

1. A multispecific antigen-binding protein comprising at least two VL regions respectively paired with at least two VH regions to form at least two antigen-binding sites and at least two CH1 regions respectively paired with two CL regions,
wherein at least one CH1/CL pair comprises a CH1 region comprising K221E and K228D mutations at Kabat positions 221 and 228 and CL region comprising D122K and E123K mutations at Kabat positions 122 and 123 to facilitate pairing, and
wherein at least one VH/VL pair comprises opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and
wherein the mutated residue in the VH region has an opposite charge from the mutated residue in the VL region.

2. A multispecific antigen-binding protein comprising:
a) a first light chain (LC1)/heavy chain (HC1) pair comprising:
(1) a first VL region (VL1) paired with first VH region (VH1) to form a first antigen-binding site;

(2) a first constant heavy chain region 1 (CH1-1) operatively linked to VH1 and a first constant light chain region (CL1) operatively linked to VL1; and
(3) a first heterodimerization domain (HD1); and
b) a second light chain (LC2)/heavy chain (HC2) pair comprising:
(4) a second VL region (VL2) paired with a second VH region (VH2) to form a second antigen-binding site;
(5) a second constant heavy chain region 1 (CH1-2) operatively linked to VH2 and a second constant light chain region (CL2) operatively linked to VL2; and
(6) a second heterodimerization domain (HD2);
wherein HD1 and HD2 heterodimerize,
wherein at least one or both of VL1 and VH1 pair and of VL2 and VH2 pair comprises opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region,
wherein at least one or both of CL1 and CH1-1 pair and of CL2 and CH1-2 pair comprises mutations to facilitate pairing, and
wherein when both of CL1 and CH1-1 pair and of CL2 and CH1-2 pair comprise mutations to facilitate pairing, the mutations in CH1-1 and CL1 to facilitate pairing are different from the mutations in CH1-2 and CL2 to facilitate pairing, wherein:
i) CH1-1 comprises a T192E mutation and CL1 comprises N137K and S114A mutations and/or CH1-2 comprises a T192E mutation and CL2 comprises N137K and S114A mutations;
ii) CH1-1 comprises L143Q and S188V mutations and CL1 comprises V133T and S176V mutations and/or CH1-2 comprises L143Q and S188V mutations and CL2 comprises V133T and S176V mutations;
iii) CH1-1 comprises T192E, L143Q and S188V mutations and CL1 comprises N137K, S114A, V133T and S176V mutations and/or CH1-2 comprises T192E, L143Q and S188V mutations and CL2 comprises N137K, S114A, V133T and S176V mutations;
iv) CH1-1 comprises a K221E mutation and CL1 comprises a E123K mutation and/or CH1-2 comprises a K221E mutation and CL2 comprises a E123K mutation;
v) CH1-1 comprises T192E and K221E mutations and CL1 comprises N137K, S114A and E123K mutations and/or CH1-2 comprises T192E and K221E mutations and CL2 comprises N137K, S114A and E123K mutations;
vi) CH1-1 comprises a K228D mutation and CL1 comprises a D122K mutation and/or CH1-2 comprises a K228D mutation and CL2 comprises a D122K mutation;
vii) CH1-1 comprises K221E and K228D mutations and CL1 comprises D122K and E123K mutations and/or CH1-2 comprises K221E and K228D mutations and CL2 comprises D122K and E123K mutations;
viii) CH1-1 comprises a L143E, a L143D, a L143K, a L143R, or a L143H mutation, and CL1 comprises a S176E, a S176D, a S176K, a S176R, or a S176H mutation and/or CH1-2 comprises a L143E, a L143D, a L143K, a L143R, or a L143H mutation, and CL2 comprises a S176E, a S176D, a S176K, a S176R, or a S176H mutation; and/or ix) CH1-1 comprises a L124E, a L124D, a L124K, a L124R, or a L124H mutation, and CL1 comprises a V133E, a V133D, a V133K, a V133R, or a V133H mutation and/or CH1-2 comprises a L124E, a L124D, a L124K, a L124R, or a L124H mutation, and CL2 comprises a V133E, a V133D, a V133K, a V133R, or a V133H mutation,
wherein the mutations are according to Kabat numbering.

3. The multispecific antigen-binding protein of claim 1, wherein at least one CH1 region is operably linked to a heterodimerization domain.

4. A multispecific antigen-binding protein comprising four polypeptide chains, that form three antigen-binding sites, wherein
a first polypeptide chain comprises a structure represented by the formula:

VL2-L1-VL1-L2-CL1     [I], a second polypeptide chain comprises a structure represented by the formula:

VH1-L3-VH2-L4-CH1-1-hinge-CH2-CH3     [II], a third polypeptide chain comprises a structure represented by the formula:

VH3-CH1-2-hinge-CH2-CH3     [III], and a fourth polypeptide chain comprises a structure represented by the formula:

VL3-CL2     [IV], wherein:
VL1 is a first immunoglobulin light chain variable domain;
VL2 is a second immunoglobulin light chain variable domain;
VL3 is a third immunoglobulin light chain variable domain;
VH1 is a first immunoglobulin heavy chain variable domain;
VH2 is a second immunoglobulin heavy chain variable domain;
VH3 is a third immunoglobulin heavy chain variable domain;
CL1 is a first immunoglobulin light chain constant domain;
CL2 is a second immunoglobulin light chain constant domain;
CH1-1 is a first immunoglobulin CH1 heavy chain constant domain;
CH1-2 is a second immunoglobulin CH1 heavy chain constant domain;
CH2 is an immunoglobulin CH2 heavy chain constant domain;
CH3 is an immunoglobulin CH3 heavy chain constant domain;
hinge is an immunoglobulin hinge region connecting the CH1 and CH2 domains;
Fc comprises an immunoglobulin hinge region and CH2 and CH3 immunoglobulin heavy chain constant domains; and
L1, L2, L3, and L4 are amino acid linkers,
wherein VH1 is paired with VL1, VH2 is paired with VL2, and CH1-1 is paired with CL1, wherein the polypeptide of formula I and the polypeptide of formula II form a cross-over light chain-heavy chain pair, wherein one or more cysteine residues are engineered into the one or more of VH1/VL1, VH2/VL2, and VH3/VL3 pairs to form one or more disulfide bonds, wherein at least one or both of VL1 and VH1 pair and of VL2 and VH2 pair comprises opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, wherein the mutated residue in the VH region has an opposite charge from the mutated residue in the VL region, and wherein one or both of the CH1-1 and CL1 domain pair and the CL2 and CH1-2 domain pair comprise mutations that facilitate pairing, wherein when both of CL1 and CH1-1 pair and of CL2 and CH1-2 pair comprise mutations to facilitate pairing, the mutations in CH1-1 and CL1 are different than the mutations in CH1-2 and CL2, wherein:

i) CH1-1 comprises a T192E mutation and CL1 comprises N137K and S114A mutations and/or CH1-2 comprises a T192E mutation and CL2 comprises N137K and S114A mutations:

ii) CH1-1 comprises L143Q and S188V mutations and CL1 comprises V133T and S176V mutations and/or CH1-2 comprises L143Q and S188V mutations and CL2 comprises V133T and S176V mutations;

iii) CH1-1 comprises T192E, L143Q and S188V mutations and CL1 comprises N137K, S114A, V133T and S176V mutations and/or CH1-2 comprises T192E, L143Q and S188V mutations and CL2 comprises N137K, S114A, V133T and S176V mutations;

iv) CH1-1 comprises a K221E mutation and CL1 comprises a E123K mutation and/or CH1-2 comprises a K221E mutation and CL2 comprises a E123K mutation;

v) CH1-1 comprises T192E and K221E mutations and CL1 comprises N137K, S114A and E123K mutations and/or CH1-2 comprises T192E and K221E mutations and CL2 comprises N137K, S114A and E123K mutations;

vi) CH1-1 comprises a K228D mutation and CL1 comprises a D122K mutation and/or CH1-2 comprises a K228D mutation and CL2 comprises a D122K mutation;

vii) CH1-1 comprises K221E and K228D mutations and CL1 comprises D122K and E123K mutations and/or CH1-2 comprises K221E and K228D mutations and CL2 comprises D122K and E123K mutations;

viii) CH1-1 comprises a L143E, a L143D, a L143K, a L143R, or a L143H mutation, and CL1 comprises a S176E, a S176D, a S176K, a S176R, or a S176H mutation and/or CH1-2 comprises a L143E, a L143D, a L143K, a L143R, or a L143H mutation, and CL2 comprises a S176E, a S176D, a S176K, a S176R, or a S176H mutation; and/or ix) CH1-1 comprises a L124E, a L124D, a L124K, a L124R, or a L124H mutation, and CL1 comprises a V133E, a V133D, a V133K, a V133R, or a V133H mutation and/or CH1-2 comprises a L124E, a L124D, a L124K, a L124R, or a L124H mutation, and CL2 comprises a V133E, a V133D, a V133K, a V133R, or a V133H mutation, wherein the mutations are according to Kabat numbering.

5. A multispecific antigen-binding protein comprising
a) a first light chain (LC1)/heavy chain (HC1) pair comprising:
(1) a first VL region (VL1) paired with first VH region (VH1) to form a first antigen-binding site;
(2) a first constant heavy chain region 1 (CH1-1) operatively linked to VH1 and a first constant light chain region (CL1) operatively linked to VL1, and
b) a second light chain (LC2)/heavy chain (HC2) pair comprising:
(3) a second VL region (VL2) paired with a second VH region (VH2) to form a second antigen-binding site; and
(4) a second constant heavy chain region 1 (CH1-2) operatively linked to VH2 and a second constant light chain region (CL2) operatively linked to VL2, wherein the C terminus of CH1-1 is operatively linked to the N terminus of VH2, wherein one or more cysteine residues are engineered into the one or both of VH1/VL1 and VH2/VL2 pairs to form one or more disulfide bonds, wherein one or both of the VL1 and VH1 pair and the VL2 and VH2 pair comprise opposite charged mutations that facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region, wherein one or both of the CL1 and CH1-1 pair and the CL2 and CH1-2 pair comprise mutations that facilitate pairing, and wherein when both of CL1 and CH1-1 pair and of CL2 and CH1-2 pair comprise mutations to facilitate pairing, the mutations in CH1-1 and CL1 are different than the mutations in CH1-2 and CL2, wherein:

i) CH-1 comprises a T192E mutation and CL1 comprises N137K and S114A mutations and/or CH1-2 comprises a T192E mutation and CL2 comprises N137K and S114A mutations;

ii) CH-1 comprises L143Q and S188V mutations and CL1 comprises V133T and S176V mutations and/or CH1-2 comprises L143Q and S188V mutations and CL2 comprises V133T and S176V mutations;

iii) CH1-1 comprises T192E, L143Q and S188V mutations and CL1 comprises N137K, S114A, V133T and S176V mutations and/or CH1-2 comprises T192E, L143Q and S188V mutations and CL2 comprises N137K, S114A, V133T and S176V mutations;

iv) CH1-1 comprises a K221E mutation and CL1 comprises a E123K mutation and/or CH1-2 comprises a K221E mutation and CL2 comprises a E123K mutation;

v) CH1-1 comprises T192E and K221E mutations and CL1 comprises N137K, S114A and E123K mutations and/or CH1-2 comprises T192E and K221E mutations and CL2 comprises N137K, S114A and E123K mutations;

vi) CH1-1 comprises a K228D mutation and CL1 comprises a D122K mutation and/or CH1-2 comprises a K228D mutation and CL2 comprises a D122K mutation;
vii) CH1-1 comprises K221E and K228D mutations and CL1 comprises D122K and E123K mutations and/or CH1-2 comprises K221E and K228D mutations and CL2 comprises D122K and E123K mutations;
viii) CH1-1 comprises a L143E, a L143D, a L143K, a L143R, or a L143H mutation, and CL1 comprises a S176E, a S176D, a S176K, a S176R, or a S176H mutation and/or CH1-2 comprises a L143E, a L143D, a L143K, a L143R, or a L143H mutation, and CL2 comprises a S176E, a S176D, a S176K, a S176R, or a S176H mutation; and/or
ix) CH1-1 comprises a L124E, a L124D, a L124K, a L124R, or a L124H mutation, and CL1 comprises a V133E, a V133D, a V133K, a V133R, or a V133H mutation and/or CH1-2 comprises a L124E, a L124D, a L124K, a L124R, or a L124H mutation, and CL2 comprises a V133E, a V133D, a V133K, a V133R, or a V133H mutation, wherein the mutations are according to Kabat numbering.

6. The multispecific antigen-binding protein of claim 2, wherein at least one CH1/CL pair comprises a CH1 region comprising K221E and K228D mutations at Kabat positions 221 and 228 and CL region comprising D122K and E123K mutations at Kabat positions 122 and 123 to facilitate pairing, and
wherein when at least two CH1/CL pairs comprise a mutation set to facilitate pairing for two different VH/VL pairs, then the at least two CH1/CL pairs do not comprise same mutations, and
wherein at least one VH/VL pair comprises opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region.

7. An antigen-binding protein comprising:
an antigen-binding domain; and
a constant heavy chain CH1 region paired with a constant light chain CL region,
wherein the antigen-binding domain selectively binds to a target antigen, and wherein:
the CH1 region comprises K221E and K228D mutations at Kabat positions 221 and 228 of the CH1 and the CL region comprises D122K and E123K mutations at Kabat positions 122 and 123,
wherein the antigen-binding protein further comprises at least one VH/VL pair comprising opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and wherein the mutated residue in the VH region has an opposite charge from the mutated residue in the VL region.

8. The antigen-binding protein of claim 7, wherein when two CH1/CL pairs comprise mutations to facilitate pairing for two different VH/VL pairs, the two CH1/CL pairs do not comprise same mutations.

9. The multispecific antigen-binding protein of claim 1, further comprising one or more cysteine residues engineered into one or several VH/VL pairs to form one or more disulfide bonds.

10. The multispecific antigen-binding protein of claim 1, comprising three HCDRs for each VH region and three LCDRs for each VL region, and further comprising binding specificity to one or more target antigens or one or more target epitopes.

11. The multispecific antigen-binding protein of claim 5, wherein the CH1 region comprises K221E and K228D mutations at Kabat positions 221 and 228 and the CL region comprises D122K and E123K mutations at Kabat positions 122 and 123; and
the VH comprises a Q39E, a Q39D, a Q39K, a Q39R, or a Q39H mutation, and
the VL comprises a Q38E, a Q38D, a Q38K, a Q38R, or a Q38H mutation.

12. The multispecific antigen-binding protein of claim 5, wherein at least one CH1/CL pair comprises CH1/CL mutations a CH1 region comprising K221E and K228D mutations at Kabat positions 221 and 228 and CL region comprising D122K and E123K mutations at Kabat positions 122 and 123 to facilitate pairing, and of
wherein at least one VH/VL pair comprises opposite charged mutations to facilitate pairing, said opposite charged mutations comprising (1) a mutated residue in the VH region at Kabat position 39 selected from E, D, K, R, or H, and (2) a mutated residue in the VL region at Kabat position 38 selected from E, D, K, R, or H, and
wherein the mutated residue in the VH region has an opposite charge from the mutated residue in the VL region.

13. The multispecific antigen-binding protein of claim 1, wherein one or both VH regions comprise one or both of 44C and 105C mutations, and one or both VL regions comprise one or both of 100C and 43C mutations.

14. The multispecific antigen-binding protein of claim 1, wherein at least one VH/VL pair comprises:
1) a VH Q39K substitution, according to Kabat numbering, and a VL Q38E substitution, according to Kabat numbering; or
2) a VH Q39E substitution, according to Kabat numbering, and a VL Q38K substitution, according to Kabat numbering.

15. The multispecific antigen-binding protein of claim 1, comprising binding affinity to Programmed Cell Death Protein 1 (PD-1) and OX40, Programmed Cell Death Ligand 1 (PD-L1) and OX40, PD-L1 and CD40, or OX40 and Glucocorticoid-Induce TNFR-Related Protein (GITR).

* * * * *

UNITED STATES PATENT AND TRADEMARK OFFICE
CERTIFICATE OF CORRECTION

| | | |
|---|---|---|
| PATENT NO. | : 11,965,030 B2 | Page 1 of 1 |
| APPLICATION NO. | : 16/725228 | |
| DATED | : April 23, 2024 | |
| INVENTOR(S) | : Amaral et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 210 days.

Signed and Sealed this
Eighth Day of October, 2024

Katherine Kelly Vidal
*Director of the United States Patent and Trademark Office*